US007824894B2

(12) United States Patent
Barrangou et al.

(10) Patent No.: US 7,824,894 B2
(45) Date of Patent: Nov. 2, 2010

(54) LACTOBACILLUS ACIDOPHILUS NUCLEIC ACIDS ENCODING FRUCTO-OLIGOSACCHARIDE UTILIZATION COMPOUNDS AND USES THEREOF

(75) Inventors: Rodolphe Barrangou, Madison, WI (US); Todd R. Klaenhammer, Raleigh, NC (US); Eric Altermann, Palmerston (NZ)

(73) Assignee: North Carolina State University, Raleigh, NC (US)

( * ) Notice: Subject to any disclaimer, the term of this patent is extended or adjusted under 35 U.S.C. 154(b) by 0 days.

(21) Appl. No.: 12/166,787

(22) Filed: Jul. 2, 2008

(65) Prior Publication Data

US 2009/0005311 A1 Jan. 1, 2009

Related U.S. Application Data

(62) Division of application No. 10/873,467, filed on Jun. 22, 2004, now Pat. No. 7,407,787.

(60) Provisional application No. 60/480,764, filed on Jun. 23, 2003.

(51) Int. Cl.
*C12N 9/10* (2006.01)
*C12N 5/02* (2006.01)
*C12Q 1/48* (2006.01)
*C07H 21/04* (2006.01)

(52) U.S. Cl. .................... 435/193; 435/15; 435/69.1; 435/252.3; 435/252.5; 435/320.1; 435/325; 536/23.2

(58) Field of Classification Search .................. None
See application file for complete search history.

(56) References Cited

U.S. PATENT DOCUMENTS

| 5,716,837 | A | * | 2/1998 | Barry et al. ................. 800/284 |
|---|---|---|---|---|
| 5,837,509 | A | | 11/1998 | Israelsen et al. |
| 6,451,584 | B2 | | 9/2002 | Tomita et al. |
| 6,476,209 | B1 | | 11/2002 | Glenn et al. |
| 6,544,772 | B1 | | 4/2003 | Glenn et al. |
| 6,635,460 | B1 | | 10/2003 | Van Hijum et al. |
| 2002/0159976 | A1 | | 10/2002 | Glenn et al. |
| 2003/0110535 | A1 | | 6/2003 | Barry et al. |
| 2003/0138822 | A1 | | 7/2003 | Glenn et al. |
| 2004/0009490 | A1 | | 1/2004 | Glenn et al. |
| 2004/0208863 | A1 | | 10/2004 | Versalovic et al. |
| 2005/0003510 | A1 | | 1/2005 | Chang et al. |

FOREIGN PATENT DOCUMENTS

| EP | 0 888 118 B1 | 1/1999 |
|---|---|---|
| WO | WO 02/12506 A1 | 2/2002 |
| WO | WO 02/074798 A2 | 9/2002 |
| WO | WO 02/077021 A2 | 10/2002 |
| WO | WO 03/084989 A2 | 10/2003 |
| WO | WO 2004/020467 A2 | 3/2004 |
| WO | WO 2004/031389 A1 | 4/2004 |
| WO | WO 2004/069178 A2 | 8/2004 |
| WO | WO 2004/096992 A2 | 11/2004 |
| WO | WO 2005/001057 A2 | 1/2005 |
| WO | WO 2005/012491 A2 | 2/2005 |

OTHER PUBLICATIONS

Sequence alignment of SEQ ID NO: 11 with SEQ ID NO: 5 of Barry et al (PAT 5716837).*
Abee, et al., "Kinetic studies of the action of lactacin F, a bacteriocin produced by *Lactobacillus johnsonii* that forms poration complexes in the cytoplasmic membrane", *Appl. Environ. Microbiology*, (1994); 60:1006-10013.
Allison and Klaenhammer, "Functional analysis of the gene encoding immunity to lactacin F *lafl*, and its use as a *Lactobacillus*-specific, food-grade genetic marker", *Appl. Environ. Microbiology*, (1996), 62:4450-4460.
Allison and Klaenhammer, "Genetics of bacteriocins produced by lactic acid bacteria and their use in novel industrial applications", *Manual of Industrial Microbiology and Biotechnology*, (1999), DeMain and Davies (eds.), ASM Press, Washington, D.C., pp. 789-808.
Allison, et al., "Expansion of bacteriocin activity and host range upon complementation of two peptides encoded with the lactacin F operon", *J. Bacteriol*. (1994), 176:2235-2241.
Altermann, et al., "Identification and phenotypic characteization of the cell-division protein CdpA", *Gene*(2004), 342:189-197.
Altermann, et al., "Complete genome sequence of the probiotic lactic acid bacterium *Lactobacillus acidophilus* NCFM", *Proc. Natl.. Acad. Sci. USA*, (2005), Early Edition 10.1073/pnas.0409188102, online publication date Jan. 25, 2005.
Azcarate-Peril, et al., "Identification and inactivation of genetic loci involved with *Lactobacillus acidophilus* acid tolerance", *Appl. Environ. Microbiology*, (2004), 70:5315-5322.
Barefoot and Klaenhammer, "Detection and activity of lactacin B, a bacteriocin produced by *Lactobacillus acidophilus*", *Appl. Environ. Microbiology*, (1983), 45:1808-1815.
Barefoot and Klaenhammer, "Purification and characterization of the *Lactobacillus acidophilus*bacteriocin lactacin B", *Antimicrob. Agents Chemother*., (1984), 26:328-334.
Barefoot et al. (1994) "Identification and purification of a protein that induces production of the *Lactobacillus acidophilus* bacteriocin lactacin B" *Appl. Environ. Microbiol*. 60:3522-3528.
Barrangou et al. (2003) "Functional and comparative genomic analyses of an operon involved in fructooligosaccharide utilization by *Lactobacillus acidophilus*" *Proc. Natl. Acad. Sci. U.S.A.* 100:8957-8962.

(Continued)

*Primary Examiner*—Delia M Ramirez
*Assistant Examiner*—Younus Meah
(74) *Attorney, Agent, or Firm*—Alston & Bird LLP

(57) ABSTRACT

Fructooligosaccharide (FOS)-related protein nucleic acid molecules and polypeptides and fragments and variants thereof are disclosed in the current invention. In addition, FOS-related fusion proteins, antigenic peptides, and anti-FOS-related antibodies are encompassed. The invention also provides recombinant expression vectors containing a nucleic acid molecule of the invention and host cells into which the expression vectors have been introduced. Methods for producing the polypeptides of the invention and methods for their use are further disclosed.

30 Claims, 9 Drawing Sheets

OTHER PUBLICATIONS

Boels et al. (2001) "Functional analysis of the *Lactococcus lactis galU* and *galE* genes and their impact on sugar nucleotide and exopolysaccharide biosynthesis" *Appl. Environ. Microbiol.* 67:3033-3040.

Bruno-Barcena et al. (2004) "Expression of heterologous manganese superoxide dismutase gene in intestinal lactobacilli provides protection against hydrogen peroxide toxicity" *Appl. Environ. Microbiol.* 70:4702-4710.

Christensen et al. (1999) "Peptidases and Amino Acid Catabolism in Lactic Acid Bacteria" *Antonie van Leeuwenhoek* 76: 217-246.

Coconnier et al. (1992) "Protein-mediated adhesion of *Lactobacillus acidophilus* BG2FO4 on human enterocyte and mucus-secreting cell lines in culture" *Appl. Environ. Microbiol.* 58:2034-2039.

Contreras et al. (1997) "Isolation, purification and amino acid sequence of lactobinA, one of the two bacteriocins produced by *Lactobacillus amylovorus* LMG P-13139" *Appl. Environ. Microbiol.* 63:13-20.

De Vuyst and Degeest (1998) "Heteropolysaccharides from lactic acid bacteria" *FEMS Microbiol. Rev.* 23:153-177.

Dodd and Gasson (1994) "Bacteriocins of lactic acid bacteria" in *Genetics and Biotechnology of Lactic Acid Bacteria* Gasson and de Vos (eds.), Blackie Academic and Professional, London, pp. 211-251.

Dopazo, J., et al., "Annotated draft genomic sequence from a Streptococcus pneumoniae type 19F clinical isolate", *Microbial Drug Resistance*, (2001), vol. 7, No. 2, pp. 99-125.

Fremaux et al. (1993) "Molecular analysis of the lactacin F operon" *Appl. Environ. Microbiol.* 59:3906-3915.

GenBank Accession No. AAA19050; filed Jan. 17, 1994; Prolinase; Source: *Lactobacillus helveticus*.

GenBank Accession No. AAA25250; filed Jan. 13, 1994; Aminopeptidase C.; Source: *Lactobacillus helveticus*.

GenBank Accession No. AAA19050; filed Jan. 17, 1994; Prolinase; Source: *Lactobacillus helveticus*.

GenBank Accession No. AAA25250; filed Jan. 13, 1994; Aminopeptidase C.; Source: *Lactobacillus helveticus*.

GenBank Accession No. AAB52540; filed Nov. 1, 1996; Endopeptidase; Source: *Lactobacillus helveticus*.

GenBank Accession No. AAB66326; filed Aug. 7, 1997; GroEL; Source: *Lactobacillus zeae*.

GenBank Accession No. AAC29003; filed Aug. 7, 1998; cochaperonin GroES; Source: *Lactobacillus helveticus*.

GenBank Accession No. AAC99363; filed Sep. 10, 1999; D-lactate dehydrogenase; Source: *Lactobacillus johnsanii*.

GenBank Accession No. AAF22492; filed Aug. 30, 2001; F1F0-ATPase subunit a; Source: *Lactobacillus acidophilus*.

GenBank Accession No. AAF22493; filed Aug. 30, 2001; F1F0-ATPase subunit c; Source: *Lactobacillus acidophilus*.

GenBank Accession No. AAF22494; filed Aug. 30, 2001; F1F0-ATPase subunit b; Source: *Lactobacillus acidophilus*.

GenBank Accession No. AAF22495; filed Aug. 30, 2001; F1F0-ATPase subunit delta; Source: *Lactobacillus acidophilus*.

GenBank Accession No. AAF22496; filed Aug. 30, 2001; F1F0-ATPase subunit alpha; Source: *Lactobacillus acidophilus*.

GenBank Accession No. AAF22497; filed Aug. 30, 2001; F1F0-ATPase subunit gamma; Source: *Lactobacillus acidophilus*.

GenBank Accession No. AAF22498; filed Aug. 30, 2001; F1F0-ATPase subunit beta; Source: *Lactobacillus acidophilus*.

GenBank Accession No. AAF22499; filed Aug. 30, 2001; F1F0-ATPase subunit epsilon; Source: *Lactobacillus acidophilus*.

GenBank Accession No. AAF75593; filed Jun. 13, 2000; GroEL; Source: *Lactobacillus johnsonii*.

GenBank Accession No. AAK97217; filed Sep. 2, 2001; cochaperonin GroES; Source *Lactobacillus acidophilus*.

GenBank Accession No. AAK97218; filed Sep. 2, 2001; chaperonin GroEL; Source: *Lactobacillus acidophilus*.

GenBank Accession No. AAK97220; filed Sep. 2, 2001; cochaperonin GrpE; Source: *Lactobacillus acidophilus*.

GenBank Accession No. AAK97221; filed Sep. 2, 2001; heat shock protein DnaK; Source: *Lactobacillus acidophilus*.

GenBank Accession No. AAQ72431; filed Aug. 11, 2003; Endopeptidase E2; Source: *Lactobacillus helveticus*.

GenBank Accession No. AAR25444; filed Dec. 3, 2003; Tuf; *Lactobacillus johnsonii*.

GenBank Accession No. AAT09141; filed Sep. 7, 2004; amino acid permease La995; Source: *Lactobacillus acidophilus*.

GenBank Accession No. AF010281; filed Aug. 9, 1997; Lactobacillus zeae GroES; Source: *Lactobacillus zeae*.

GenBank Accession No. AF031929; filed Aug. 8, 1998; Lactobacillus helveticus cochaperonin GroES and chaperonin GroEL genes, complete cds and DNA mismatch repair enzyme (hexA) gene, partial cds; Source: *Lactobacillus helveticus*.

GenBank Accession No. AF071558; filed Sep. 10, 1999; Lactobacillus johnsonii D-lactate dehydrogenase (ldhD) gene, complete cds; Source: *Lactobacillus johnsonii*.

GenBank Accession No. AF098522; filed Aug. 30, 2001; Lactobacillus acidophilus uracil phosphoribosyltransferase; Source: *Lactobacillus acidophilus*.

GenBank Accession No. AF214488; filed Jun. 13, 2000; Lactobacillus johnsonii groESL operon, complete sequence and unknown gene; Source: *Lactobacillus johnsonii*.

GenBank Accession No. AF300645; filed Sep. 2, 2001; Lactobacillus acidophilus groESL operon, complete sequence; Source: *Lactobacillus acidophilus*.

GenBank Accession No. AF300646; filed Sep. 2, 2001; Lactobacillus acidophilus repressor protein HrcA (hrcA) gene, partial cds; cochaperonin GrpE (grpE) and heat shock protein DnaK (dnaK) genes, complete cds, and DnaJ (dnaJ) gene, partial cds; Source: *Lactobacilus acidophilus*.

GenBank Accession No. B59088; filed Oct. 22, 1999; Prolyl Aminopeptidase; Source: *Lactobacillus helveticus*.

GenBank Accession No. CAA42781; filed Nov. 5, 1992; D-lactate dehydrogenase; Source: *Lactobacillus delbrueckii*.

GenBank Accession No. CAA59019; filed Apr. 18, 2005; heat shock induced protein HtpI; Source: *Lactobacillus leichmannii*.

GenBank Accession No. CAA61561; filed Jan. 22, 1996; SB-protein; *Lactobacillus acidophilus*.

GenBank Accession No. CAA86210; filed Oct. 10, 1994; Dipeptidase; Source: *Lactobacillus helveticus*.

GenBank Accession No. CAB72938; filed Jun. 23, 1999; Tripeptidase Enzyme; Source: *Lactobacillus helveticus*.

GenBank Accession No. NP_964658; filed Jan. 26, 2007; probable xylulose5-phosphate/fructose-6-phosphate phosphoketolase; Source: *Lactobacillus johnsonii NCC 533*.

GenBank Accession No. NP_964694; filed Jan. 26, 2007; RecA protein; Source: *Lactobacillus johnsonii NCC 533*.

GenBank Accession No. NP_964728; filed Jan. 26, 2007; phosphoglycerate kinase; Source: *Lactobacillus johnsonii NCC 533*.

GenBank Accession No. NP_964948; filed Jan. 26, 2007; DNA-binding protein HU; Source: *Lactobacillus johsonii NCC 533*.

GenBank Accession No. NP_965314; filed Jan. 26, 2007; 50S ribosomal protein L19; Source: *Lactobacillus johnsonii NCC 533*.

GenBank Accession No. NP_965472; filed Jan. 26, 2007; thioredoxin; Source: *Lactobacillus johnsonii NCC 533*.

GenBank Accession No. NP_965500; filed Jan. 26, 2007; hypothetica protein LJ1693; Source: *Lactobacillus johnsonii NC 533*.

GenBank Accession No. O07684; filed Oct. 17, 2006; Beta-galactosidase large subunit; Source: *Lactobacillus acidophilus*.

GenBank Accession No. O07685; filed Nov. 28, 2006; Beta-galactosidase small subunit; Source: *Lactobacillus acidophilus*.

GenBank Accession No. O32755; filed Oct. 17, 2006; Glyceraldehyde-3-phosphate dehydrogenase; Source: *Lactobacillus delbrueckii* subsp. *Bulgaricus*.

GenBank Accession No. O32756; filed Apr. 18, 2006; Phosphoglycerate kinase; Source: *Lactobacillus delbrueckii* subsp. *Bulgaricus*.

GenBank Accession No. O32765; filed Nov. 28, 2006; L-lactate dehydrogenase; Source: *Lactobacillus helveticus*.

GenBank Accession No. O68324; filed Mar. 21, 2006; 60 kDa chaperonin; Source: *Lactobacillus helveticus*.

GenBank Accession No. O84913; filed Jul. 1, 1997; Xaa-Pro dipeptidase; Source: *Lactobacillus helveticus*.

GenBank Accession No. P26297; filed Jan. 23, 2007; D-lactate dehydrogenase; Source:*Lactobacillus delbrueckii* subsp. *Bulgaricus*.
GenBank Accession No. P94870; filed May 1, 1997; Aminopeptidase E.; Source:*Lactobacillus helveticus*.
GenBank Accession No. P30901; D-lactate dehydrogenase; Source:*Lactobacillus helveticus*.
GenBank Accession No. P34038; Pyruvate kinase; Source:*Lactobacillus delbrueckii* subsp. *Bulgaricus*.
GenBank Accession No. P35829; S-layer protein precursor; Source: *Lactobacillus acidophilus*.
GenBank Accession No. P43451; ATP synthase beta chain; Source:*Enterococcus hirae*.
GenBank Accession No. Q00052; filed Mar. 21, 2006; Galactokinase; Source:*Lactobacillus helveticus*.
GenBank Accession No. Q10730; filed Oct. 1, 1996; Aminopeptidase N; Source:*Lactobacillus helveticus*.
GenBank Accession No. Q10744; filed Nov. 1, 1996; Aminopeptidase C.; Source:*Lactobacillus helveticus*.
GenBank Accession No. Q48558; filed Sep. 26, 2001; Dipeptidase A.; Source:*Lactobacillus helveticus*.
GenBank Accession No. Q9Z4H7; filed Oct. 17, 2006; Serine protease do-like htrA; Source: *Lactobacillus helveticus*.
GenBank Accession No. S47274; filed Feb. 1, 1994; Membrane Alanyl Aminopeptidase; Source: *Lactobacillus helveticus*.
GenBank Accession No. S47276; filed Jan. 6, 1995; Prolinase; Source: *Lactobacillus helveticus*.
GenBank Accession No. X60220; filed Nov. 5, 1992, *L. delbrueckii* subsp. Bulgaricus 1 dhA gene for D lactate dehydrogenase; Source: *Lactobacillus delbrueckii*.
GenBank Accession No. X84261; filed Apr. 18, 2005; L.Leichmannii xerC, hslU and hslV; Source: *Lactobacillus leichmannii*.
GenBank Accession No. X89376, filed Jan. 22, 1996, L. acidophilus DNA for SB-protein gene; Source: *Lactobacillus acidophilus*.
GenBank Accession No. ZP_00046537; filed May 25, 2006; COG0124: Histidyl-tRNA sythetase; Source: *Lactobacillus gasseri*.
GenBank Accession No. ZP_00046557; filed May 25, 2006; COG0148: Enolase; Source:*Lactobacillus gasseri*.
GenBank Accession No. X60220; filed Nov. 5, 1992; *L. delbrueckii* subsp. Bulgaricus 1dhA gene for D-lactate dehydrogenase; Source:*Lactobacillus delbrueckii*.
GenBank Accession No. X84261; filed Apr. 18, 2005; L. Leichmannii xerC, hslU and hslV; Source: *Lactobacillus leichmannii*.
GenBank Accession No. X89376; filed Jan. 22, 1996; L. acidophilus DNA for SB-protein gene: Source: *lactobacillus acidophilus*.
GenBank Accession No. ZP_00046583; filed May 25, 2006; COG0195; Transcription elongation factor; Source: *Lactobacillus gasseri*.
GenBank Accession No. ZP_00047305; filed May 25, 2006; COG4690: Dipeptidase; Source: *Lactobacillus gasseri*.
GenBank Accession No. ZP_00341831; filed May 25, 2006; COG0522: Ribsomal protein S4 and related proteins; Source: *Lactobacillus gasseri*.
GenBank Accession No. Q03234; filed Oct. 17, 2006; ATP synthesis beta chain; *Lactobacillus casei*.
Girgis et al. (2002) "Stress adaptations of lactic acid bacteria"in *Microbial adaptation to stress and safety of new-generation foods*. Yousef and Juneja (eds.) CRC Press, NY, pp. 159-212.
Greene and Klaenhammer (1994) "Factors involved in adherence of lactobacilli to human Caco-2 cells" *Appl. Environ. Microbiol.* 60:4487-4494.
Holzapfel et al. (2001) "Taxonomy and Important Features of Probiotic Microorganisms in Food and Nutrition" *Am J of Clil Nutr* 73 Suppl: 365S-373S.
Hugenholtz (1999) "Metabolic Engineering of Lactic Acid Bacteria: Overview of the Approaches and Results of Pathway Rerouting Involved in Food Fermentations"*Current Opinion in Biotechnology* 10: 492-497.
Joerger and Klaenhammer (1986) "Characterization and purification of helveticin J and evidence for a chromosomally determined bacteriocin produced by*Lactobacillus helveticus*" *J. Bacteriol.* 167:439-446.

GenBank Accession No. ZP_00047305; filed May 25, 2006; COG4690: Dipeptidase; Source: *Lactobacillus gasseri*.
GenBank Accession No. ZP_00341831; filed May 25, 2006; COG0522: Ribosomal protein S4 and related proteins; Source: *Lactobacillus gasseri*.
GenBank Accession No. Q03234; filed Oct. 17, 2006; ATP synthesis beta chain; *Lactobacillus casei*.
Girgis et al. (2002) "Stress adaptations of lactic acid bacteria"in *Microbial adaptation to stress and safety of new-generation foods*. Yousef and Juneja (eds.) CRC Press, NY, pp. 159-212.
Hoskins, J., et al., Genome of the bacterium Streptococcus pneumoniae strain R6, *Journal of Bacteriology, Washington, DC*, vol. 183, No. 19, (2001), pp. 5709-5717.
James, L.C., et al.. "Nucleotide sequence of the FTFA gene from S. mutans GS5", *Nucleic Acids Research, Oxford Universiy*, (1988), vol. 16, No, 21, p. 10398.
Joerger et al. (1990) "Cloning, expression, and nucleotide sequence of the*Lactobacillus helveticus* 481 gene encoding the bactericin helveticin J"*J. Bacteriol.* 172:6339-6347.
Jolly et al. (2002) "Exploiting exopolysaccharides from lactic acid bacteria" *Antonie van Leeuwenhoek* 82:367-374.
Kaplan, H., et al., "Fermentation of fructooligosaccharides by lactic acid bacteria and bifidobacteria", *Applied and Environmental Microbiology, Washington, DC*, (2000), vol. 66, No. 6, pp. 2682-2684.
Klaenhammer (1988) "Bacteriocins of lactic acid bacteria" *Biochimie* 70:337-349.
Klaenhammer (1993) "Genetics of bacteriocins produced by lactic acid bacteria" *FEMS Microbiol. Rev.* 12:39-85.
Klaenhammer (2000) "Probiotic bacteria: today and tomorrow" *J. Nutr.* 130(2S Suppl.):415S-416S.
Klaenhammer and Kullen (1999) "Selection and design of probiotics" *Int. J. Food Microbiol.* 50:45-57.
Klaenhammer and Sutherland (1980) "Detection of plasmid deoxyribonucleic acid in an isolate of *Lactobacillus acidophilus*" *Appl. Environ. Microbiol.* 39:671-674.
Klaenhammer et al. (2002) "Discovering lactic acid bacteria by genomics" *Antonie van Leeuenhoek* 82:29-58.
Klaenhammer et al. (2002) "Discovering lactic acid bacteria by genomics"*Antonie van Leeuenhoek* 82:29-58.
Kleeman and Klaenhammer, (1982) "Adherence of*Lactobacillus* species to human fetal intestinal cells", *J. Diary Sci.* 65:2063-2069.
Kleerebezem et al. (1999) "Exopolysaccharides produced by*Lactococcus lactis*: from genetic engineering to improved rheological properties?"*Antonie van Leeuwenhoek* 76:357-365.
Kleerebezem et al. (2003) "Complete genome sequence of*Lactobacillus plantarum* WCFS1" *Proc. Natl. Acad. Sci. U.S.A.* 100:1990-1995.
Kok et al. (1994) "The Proteolytic System of Lactic Acid Bacteria" *Genetics and Biotechnology of Lactic Acid Bacteria* pp. 169-210.
Konigs et al. (1997) "The role of transport processes in survival of lactic acid bacteria"*Antonie van Leeuwenhoek*71:117-128.
Konigs et al. (2000) "Lactic acid bacteria: the bugs of a new millennium" *Curr. Opin. Microbiol.* 3:276-282.
Kleerebezem et al. (1999) "Exopolysaccharides produced by*Lactococcus lactis*: from genetic engineering to improved rheological properties?"*Antonie van Leeuwenhoek* 76:357-365.
Kleerebezem et al. (2003) "Complete genome sequence of*Lactobacillus plantarum* WCFS1" *Proc. Natl. Acad. Sci. U.S.A.* 100:1990-1995.
Kok et al. (1994) "The Proteolytic System of Lactic Acid Bacteria"*Genetics and Biotechnology of Lactic Acid Bacteria* pp. 169-210.
Kuipers et al. (2000) "Current Strategies for Improving Food Bacteria"*Res Microbiol* 151: 815-822.
Kullen and Klaenhammer (1999) Identification of the pH-inducible, proton-translocating $F_1F_0$-ATPase (atpBEFHAGDC) operon of*Lactobacillus acidophilus* by differential display: gene structure, cloning and characterization *Mol. Microbiol.* 33:1152-1161.
Kullen and Klaenhammer (2000) "Genetic modification of intestinal lactobacilli and bifidobacteria" *Curr. Issues Mol. Biol.* 2:41-50.

Kullen et al. (2000) "Use of the DNA sequence of variable regions of the 16S rRNA gene for rapid and accurate identification of bacteria in the Lactobacillus acidophilus complex" J. Appl. Microbiol. 89:511-516.

Law et al. (1997) "Proteolytic Enzymes of Lactic Acid Bacteria" Int Dairy Journal 7: 1-11.

Luchansky, et al., (1988) "Application of electroporation for transfer of plasmid DNA to Lactobacillus, Lactococcus, Leuconostoc, Listeria, Pediococcus, Bacillus, Staphylococcus, Enterococcus and Propionobacterium" Mol. Microbiol. 2:637-646.

Luchansky et al. (1989) "Genetic transfer systems for delivery of plasmid deoxyribonucleic acid to Lactobacillus acidophilus ADH: conjugation, electroporation, and transduction" J. Dairy Sci. 72:1408-1417.

Luchansky et al. (1991) "Molecular cloning and deoxyribonucleic acid polymorphisms in Lactobacillus acidophilus and Lactobacillus gasseri" J. Dairy Sci. 74:3293-3302.

Majhenic et al. (2004) "DNA analysis of the genes encoding acidocin LF221 A and acidocin LF22 B, two bacteriocins produced by Lactobacillus gasseri LF221" Appl. Microbiol. Biotechnol. 63:705-714.

McLaughlin, R., et al., "The multiple sugar metabolism (msm) gene cluster of Streptococcus mutans is transcribed as a single operon", (1996), FEMS Microbiology Letters, vol. 140, No. 2-3, pp. 261-264.

Mohamadzadeh et al. (2005) "Lactobacilli activate human dendritic cells that skew T cells toward T helper 1 polarization" Proc. Nat. Acad. Sci. USA 102:2880-2885.

Muriana and Klaenhammer (1991) "Cloning, phenotypic expression, and DNA sequence of the gene for lactacin F, an antimicrobial peptide produced by Lactobacillus spp." J. Bacteriol. 173:1779-1788.

Muriana and Klaenhammer (1991) "Purification and partial characterization of Lactacin F, an bacteriocin produced by Lactobacillus acidophilus 11088" Appl. Environ. Microbiol. 57:114-121.

Pao et al. (1998) "Major Facilitator Superfamily" Microbiol. Mol. Biol. Rev. 62:1-34.

Poolman (2002) "Transporters and their roles in LAB cell physiology" Antonie van Leeuwenhoek 82:147-164.

Pridmore et al. (2004) "The genome sequence of the probiotic intestinal bacterium Lactobacillus johnsonii NCC 533" Proc. Natl. Acad. Sci. U.S.A. 101:2512-2517.

Putman et al. (2000) "Molecular properties of bacterial multidrug transporters" Microbiol. Mol. Biol. Rev. 64:672-693.

Oda and Miyuki, "Characterization of a mutant from Lactobacillus amylovorus JCM 1126T with improved utilization of sucrose", Current Microbiology, vol. 41, pp. 392-395.

Rastall et al. (2005). Modulation of the microbial ecology of the human colon by probiotics, prebiotics and synbiotics to enhance human health: An overview of enabling science and potential applications. FEMS Microbiol. Ecol. 52:145-152.

Roy et al. (1993) "Cloning and expression of the manganese superoxide dismutase gene of Escherichia coli in Lactococcus lactis and Lactobacillus gasseri" Mol. Gen. Genet. 239:33-40.

Russell and Klaenhammer (2001) "Efficient system for directed integration into the Lactobacillus acidophilus and Lactobacillus gasseri chromosomes via homologous recombination" Appl. Environ. Microbiol. 67:4361-4364.

Russell and Klaenhammer (2001) "Identification and cloning of gusA, encoding a new β-glucuronidase from Lactobacillus gasseri ADH" Appl. Environ. Microbiol. 67:1253-1261.

Sablon et al. (2000) "Antimicrobiol peptides of lactic acid bacteria: mode of action, genetics and biosynthesis" in Advances in Biochemical Engineering/Biotechnology. vol. 68. Schleper (ed.), Springer-Verlag, Berlin, pp. 21-60.

Sanders and Klaenhammer (2001) "Invited review: the scientific basis of Lactobacillus acidophilus NCFM functionality as a probiotic" J. Dairy Sci. 84:319-331.

Sanders et al. (1996) "Performance of commercial cultures in fluid milk applications" J. Dairy Sci. 79:943-955.

Sghir, A., et al., "Continuous culture selection of bifidobacteria and Lactobacilli from human faecal samples using fructooligosaccharide as selective substrate", Journal of Applied Microbiology, (1998), vol. 85, No. 4, pp. 769-777.

Steidler et al. (1998) "Functional display of a heterologous protein on the surface of Lactococcus lactis by means of the cell wall anchor of Staphylococcus aureus protein A" Appl. Environ. Microbiol. 64:342-345.

Sturino and Klaenhammer (2004) "Bacteriophage defense systems for lactic acid bacteria" Adv. Appl. Microbiol. 56:331-378.

Sutcliffe, I.C., et al., "MsmE, a lipoprotein involved in sugar transport in streptococcus mutans", Journal of Bacteriology, (1993), vol. 175, No. 6, pp. 1853-1855.

Tettelin, H., et al., "Complete genome sequence of a virulent isolate of streptococcus pneumoniae", Science, American Association for the Advancement of Science, (2001), vol. 293, No. 5529, pp. 498-506.

Van Hijum, et al., "Characterization of a novel fructosyltransferase from lactobacillus reuteri that synthesizes high-molecular-weight inulin and inulin oligosaccharides", 2002, vol. 68(9), pp. 4390-4398.

Ventura et al. (2003) "Analysis, characterization, and loci of tuf genes in Lactobacillus and Bifidobacterium species and their direct application for species identification" Appl. Environ. Microbiol. 69:6908-6922.

Vos, et al., (1991) "Engineering of the L. cactococcus lactis Serine Proteinase by Construction of Hybrid Enzymes", Protein Engineering 4(4):479-484.

Yanai, K.., "Molecular cloning and characterization of the fructooligosaccharide-producing βfructofuranosidase gene from Aspergillus niger ATCC 20611", 2001, vol. 65(4), pp. 766-773.

Yother et al. (2002) Genetics of streptococci, lactococci, and enterococci: review of the sixth international conference J. Bacteriol. 184:6085-6092.

Walker et al. (1999) "The groESL chaperone operon of Lactobacillus johnsonii" Appl. Environ. Microbiol. 65:3033-3041.

* cited by examiner

```
1231 aaatggcaataccacaaaaTAActgttgacaagttgtgaaagcgatattatcatttaatt 1291 gtaaattgaaaacgtttccaaagtgttcaaatagttttttgctaaataattattttttg 1351 tagcgaaaTAGAAACGTTTCAAttaatttaaaacaattagatcttagtaggaaaccttt
              cre2
1411 aattttttgtgcaaaaTTGAAACGTTTCAAaAGGAGGaaaaATGaaaaaatggaaattagg
              cre1
```

Figure 3
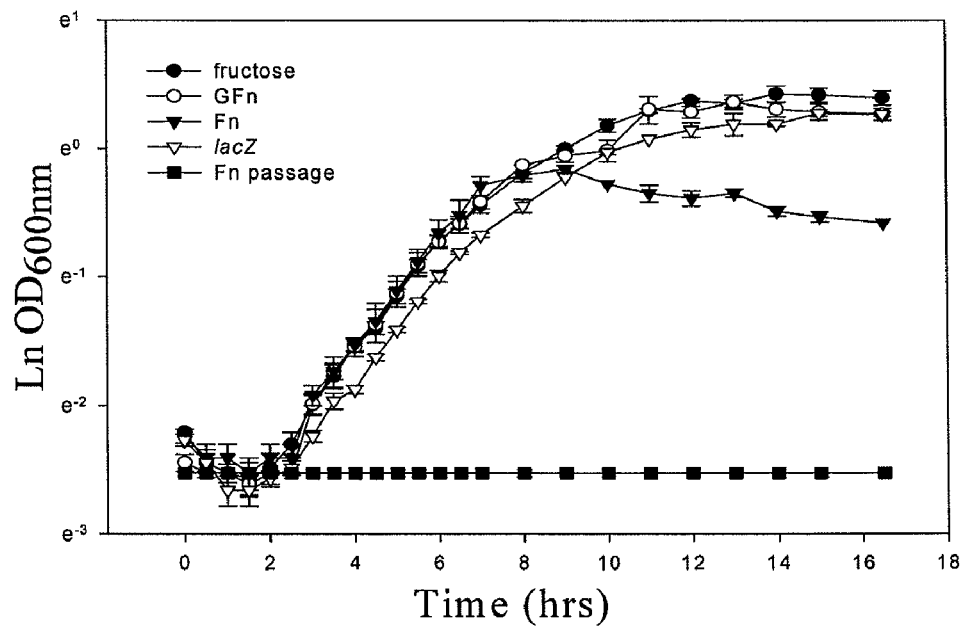
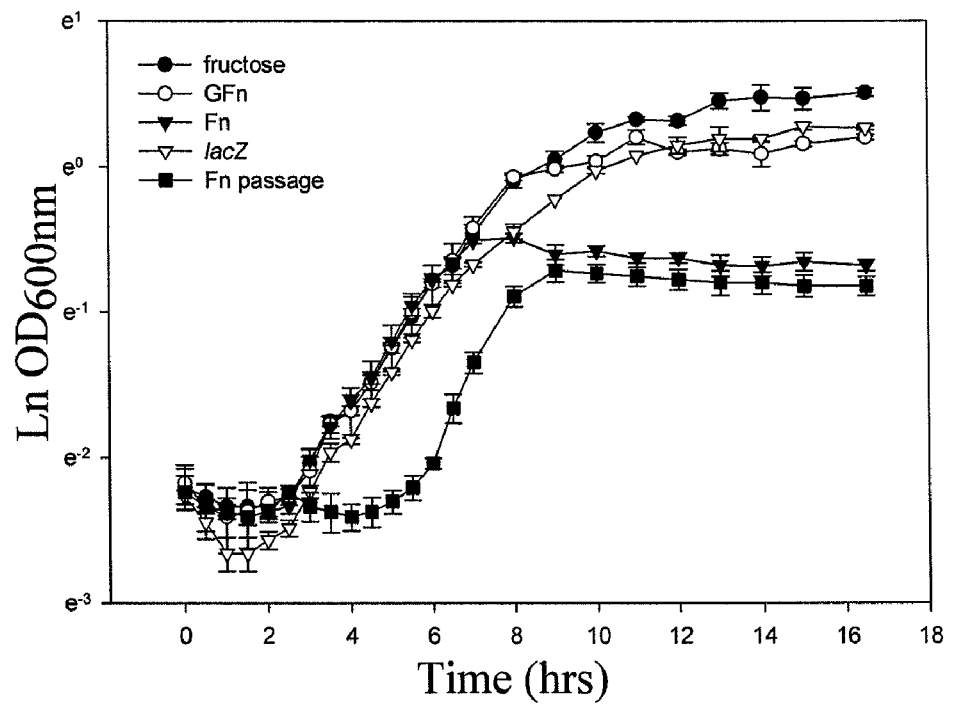

Figure 4
A
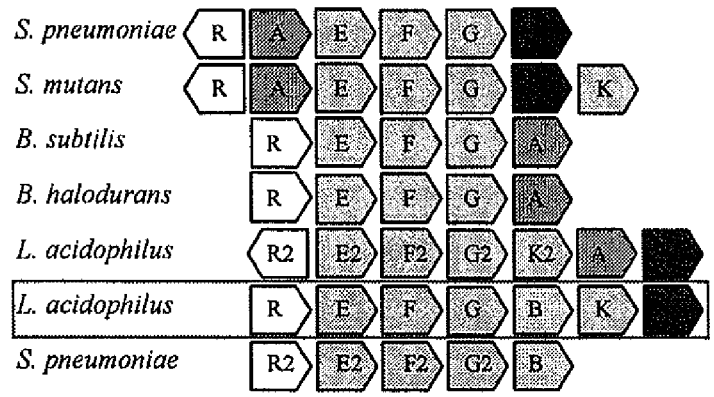
B
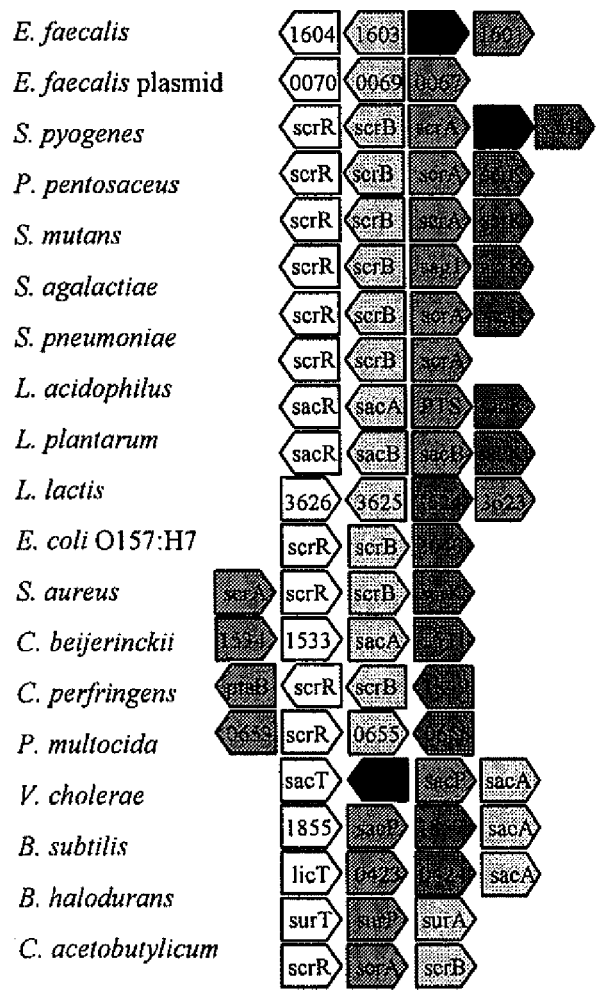

Figure 7
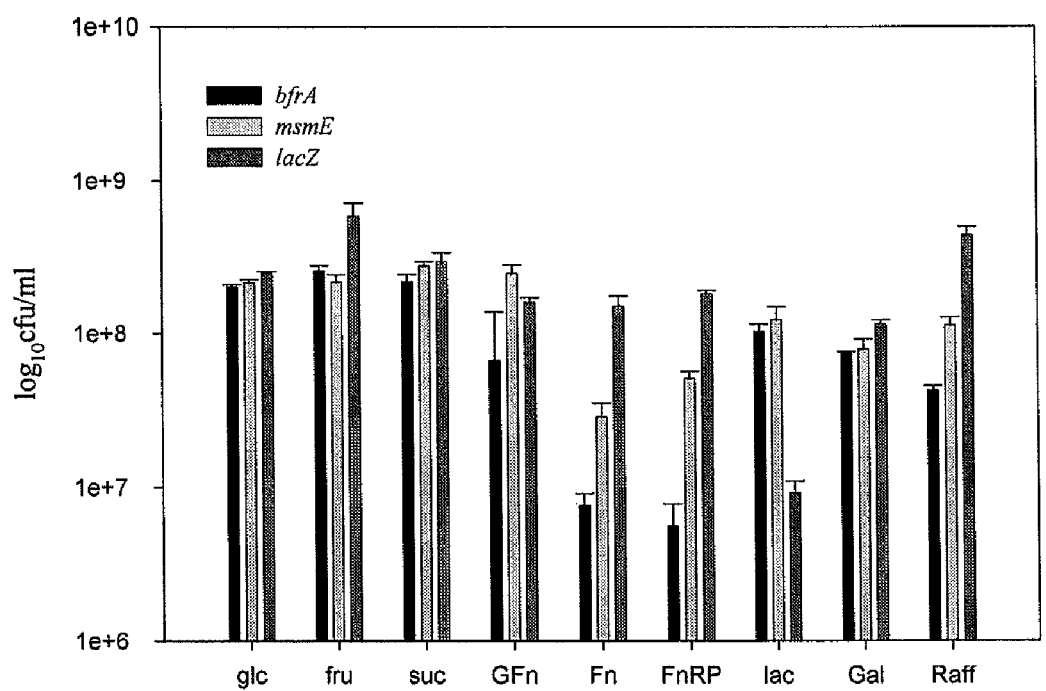
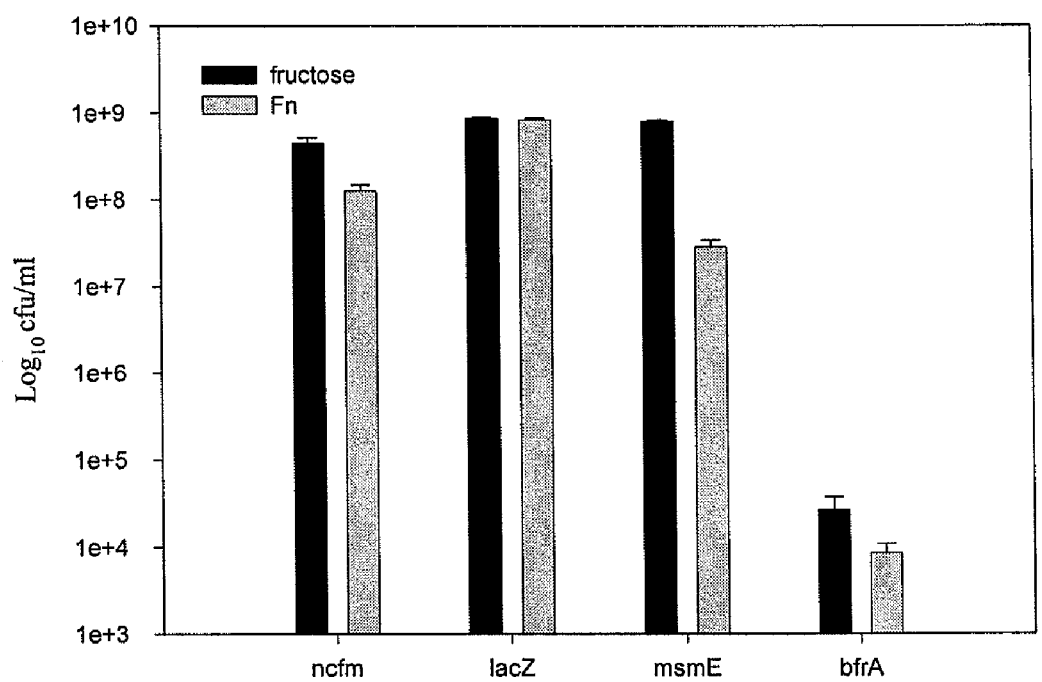

Figure 8A

```
                           Helix    Turn   Helix      (SEQ ID NO:)
LacI consensus *          TLKDVARLAGVSKSTVSRVLN           215
B. halodurans_msmR     MATLKDIAKLANVSNATVSRVLNR   24      216
B. subtilis_msmR       MVRLKDIALKAKVSSATVSRILNE   24      217
K. pneumoniae_scrR     RVTLKDIAELAGVSKATASLVLNG   28      218
S. typhimurium_scrR    RVLLKDIAEQAGVSKATASLVLNG   28      219
P. multocida_scrR      RILLSDIAKCCGLSTTLVSMILNN   31      220
C. beijerinckii_scrR   KVTLQDIANMVNVGKSSVSRYLNN   27      221
C. perfringens_1533    KVLLQDIANMVGVSKSTVSRYLNG   26      222
B. halodurans_1855     MTLLLDIAKLAGVAKSIVSRYLNG   24      223
S. aureus_scrR         MKNTSDIAKLAGVSKSTVSRFLNN   24      224
S. xylosus_scrR        MKNTADIAKIAGVSKSTVSRYLNN   24      225
E. faecalis_0070       VAKLTDVAELAGVSPTTVSRVINN   35      226
S. pyogenes_scrR       VAKLTDVAALAGVSPTIVSRVINK   25      227
S. agalactiae_scrR     VAKLTDVAALAGVSPTIVSRVINK   25      228
S. mutans_scrR         VAKLTDVAKLAGVSPTIVSRVINR   25      229
S. pneumoniae_scrR     VAKLTDVAKLAGVSPTIVSRVINK   25      230
E. faecalis_1604       VVKLTDVAKLAGVSPTTVSRVINN   28      231
L. lactis_sacR         MIKLEDVANKAGVSVTTVSRVINR   24      232
L. acidophilus_scrR    PAKLSDVAREAGCSVTTVSRVINN   25      233
L. gasseri_scrR        MVKLTDVAAKAGCSVTTVSRVINN   26      234
L. plantarum_sacR      KPKLNDVAKLAGVSATTVSRVINN   25      235
P. pentosaceus_scrR    KPKLNDVAKLAGVSATTVSRVINN   25      236
L. acidophilus_msmR    MATMKDVAQRAGVGVGTVSRVINH   23      237
S. pneumoniae_scrR2    SITMKDVALEAGVGVGTVSRVINK   32      238
V. alginolyticus_scrR  --SLHDVARLAGVSKSTVSRVIND   24      239
E. coli_3626           MASLKDVARLAGVSMMTVSRVMHN   24      240
B. longum_BL0107       MVTMKEIANKAGVSVSTVSLVLNG   25      241
R. solanacearum_scrR   RPTLRDVATLAGVSTSTVSRVLNN   34      242
```

Figure 8B

| | | (SEQ ID NO:) | | (SEQ ID NO:) | | | (SEQ ID NO:) |
|---|---|---|---|---|---|---|---|
| consensus | | 243 | WINDPNGL | 280 | HFDP | | — |
| L. acidophilus_bfrA | 38 | 244 | WINDPNGL | 281 | SNFPDPKV 161 | MYHCRDYF 214 | 317 |
| S. pneumoniae_sacA | 45 | 245 | WINDPNGF | 282 | ADFPDRKL 170 | MWECRDYF 224 | 318 |
| E. coli_3625 | 43 | 246 | WMNDPNGL | 283 | MHFPDPKV 165 | MWECPDFF 220 | 319 |
| B. longum | 45 | 247 | WINDPNGL | 284 | HHYRDPKV 167 | MLECPDFF 222 | 320 |
| P. multocida_scrB | 71 | 248 | LLNDPNGL | 285 | EHVRDPKP 190 | MVECRDLL 249 | 321 |
| V. alginolyticus_scrB | 55 | 249 | LLNDPNGL | 286 | EHFPDPKV 172 | MWECPDFF 228 | 322 |
| L. acidophilus_scrB | 51 | 250 | LINDPNGF | 287 | EHHPDPQI 169 | MTECPNLV 226 | 323 |
| L. gasseri_scrB38 | 51 | 251 | LLNDPNGF | 288 | EHHPDRQL 170 | MHECPNLV 227 | 324 |
| S. mutans_scrB | 51 | 252 | LLNDPNGF | 287 | EHEPDPQI 170 | MTECPNLV 228 | 325 |
| S. sobrinus_scrB | 51 | 253 | LLNDPNGF | 290 | EHHPDPQI 170 | MIECPNLL 228 | 326 |
| E. faecalisp_0069 | 51 | 254 | LLNDPNGF | 291 | DHFPDPQI 170 | MIECPNLL 228 | 327 |
| S. pneumoniae_scrB | 51 | 255 | LLNDPNGF | 292 | DHYPDPQI 170 | MMECPNLV 228 | 328 |
| S. agalactiae | 51 | 256 | LINDPNGH | 293 | EHFPDPQI 170 | MIECPNII 228 | 329 |
| S. pyogenes_scrB | 51 | 257 | LLNDPNGF | 294 | EHHPDPQL 170 | MTECPNLV 228 | 330 |
| L. lactis_sacA | 51 | 258 | LLNDPNGF | 295 | DHEPDPQI 171 | MIECPNLI 229 | 331 |
| L. plantarum_sacA | 51 | 259 | LLNDPNGF | 296 | SSDEDPDL 120 | MIECPNLV 176 | 332 |
| P. pentosaceus_scrB | 51 | 260 | LLNDPNGF | 297 | SSFPDPDL 171 | MIECPKSG 227 | 333 |
| E. faecalis_1603 | 56 | 261 | LLNDPNGF | 298 | SHFPDMV 175 | MVFCPNLV 233 | 334 |
| S. aureus_scrB | 52 | 262 | LLADPNGL | 299 | SHFPDPKV 172 | MWECPDYF 228 | 335 |
| S. xylosus_scrB | 52 | 263 | LLNDPNGL | 300 | QHFPDPKI 172 | MWECPDYF 228 | 336 |
| L. gasseri_scrB58 | 77 | 264 | MLGDPNGF | 301 | GHFPDPKI 205 | MWECPSDYF 261 | 337 |
| C. beijerinckii_scrB | 45 | 265 | LINDPNGL | 302 | AHFRDPYV 164 | MWECPNII 220 | 338 |
| C. perfringens_sacA | 43 | 266 | LINDPNGF | 303 | AHERDPYI 162 | MWECPSFF 218 | 339 |
| B. subtilis_sacA | 45 | 267 | LLNDPNGV | 304 | AHFTDSEV 167 | MWECRDLF 226 | 340 |
| G. stearothermophilus surA | 47 | 268 | LMPDPNGF | 305 | AHFDFK 167 | MWECPDLF 226 | 341 |
| B. halodurans_sacA | 47 | 269 | LLNDPNGF | 306 | AHHPDPKV 165 | MVECPDLF 225 | 342 |
| C. acetobutylicum_sacA | 45 | 270 | FMNDPNGL | 307 | RHFPDRKV 166 | MWECPNLF 226 | 343 |
| K. pneumoniae_scrB | 45 | 271 | LLADPNGF | 308 | GHVPDPKV 163 | MWECPDLF 223 | 344 |
| S. typhimurium_scrB | 45 | 272 | LMPDPNGF | 309 | GHVPDPKV 163 | MWECPDLF 223 | 345 |
| V. cholerae_0655 | 112 | 273 | LLNDPNGF | 310 | EHIPDPKV 232 | MWECPDWF 288 | 346 |
| R. solanacearum_scrB | 33 | 274 | LLNDPNGL | 311 | GHFPDPKA 152 | MYHCPDLF 207 | 347 |
| T. maritima_bfrA | 21 | 275 | WMNDPNGM | 312 | HAFPDPKV 141 | EHECPDLV 195 | 348 |
| B. subtilis_sacC | 53 | 276 | WMMDPNGM | 313 | KDFPDPKV 175 | VWHCPDLF 228 | 349 |
| S. mutans_fruA | 499 | 277 | WANDPNGL | 314 | QDFEDPKV 605 | HTFCPDMY 649 | 350 |
| M. laevaniformans_levM | 90 | 278 | WMNDPQRP | 315 | RDFPDPKV 221 | TIECPDLF 275 | 351 |
| S. mutans_fruB | 52 | 279 | FMNDIQTI | 316 | QNARDPYI 173 | LVECPNLK 234 | 352 |

US 7,824,894 B2

LACTOBACILLUS ACIDOPHILUS NUCLEIC ACIDS ENCODING FRUCTO-OLIGOSACCHARIDE UTILIZATION COMPOUNDS AND USES THEREOF

CROSS REFERENCE TO RELATED APPLICATIONS

This application is a divisional application of U.S. application Ser. No. 10/873,467, filed Jun. 22, 2004, now U.S. Pat. No. 7,407,787, which claims the benefit of U.S. Provisional Application Ser. No. 60/480,764, filed Jun. 23, 2003, the contents of each are herein incorporated by reference in its entirety.

REFERENCE TO SEQUENCE LISTING SUBMITTED ELECTRONICALLY

The official copy of the sequence listing is submitted electronically via EFS-Web as an ASCII formatted sequence listing with a file named 346115SEQLIST.txt, created on Jul. 2, 2008, and having a size of 760 KB and is filed concurrently with the specification. The sequence listing contained in this ASCII formatted document is part of the specification and is herein incorporated by reference in its entirety.

FIELD OF THE INVENTION

This invention relates to polynucleotides isolated from lactic acid bacteria, namely *Lactobacillus acidophilus*, and polypeptides encoded by them, as well as methods for using the polypeptides and microorganisms expressing them.

BACKGROUND OF THE INVENTION

*Lactobacillus acidophilus* is a Gram-positive, rod-shaped, non-spore forming, homofermentative bacterium that is a normal inhabitant of the gastrointestinal and genitourinary tracts. Since its original isolation by Moro (1900) from infant feces, the "acid loving" organism has been found in the intestinal tract of humans, breast fed infants, and persons consuming high milk-, lactose-, or dextrin diets. Historically, *L. acidophilus* is the *Lactobacillus* species most often implicated as an intestinal probiotic capable of eliciting beneficial effects on the microflora of the gastrointestinal tract (Klaenhammer, T. R., and W. M. Russell. 2000. Species of the *Lactobacillus acidophilus* complex. *Encyclopedia of Food Microbiology*, Volume 2, pp 1151-1157. Robinson, R. K, Batt, C., and Patel, P. D (eds). Academic Press, San Diego). *L. acidophilus* can ferment hexoses, including lactose and more complex oligosaccharides (Kaplan and Hutkins (2000) *Appl. Environ. Microbiol.* 66, 2682-2684) to produce lactic acid and lower the pH of the environment where the organism is cultured. Acidified environments (e.g. food, vagina, and regions within the gastrointestinal tract) can interfere with the growth of undesirable bacteria, pathogens, and yeasts. The organism is well known for its acid tolerance, survival in cultured dairy products, and viability during passage through the stomach and gastrointestinal tract. Lactobacilli and other commensal bacteria, some of which are considered as probiotic bacteria that "favor life," have been studied extensively for their effects on human health, particularly in the prevention or treatment of enteric infections, diarrheal disease, prevention of cancer, and stimulation of the immune system.

SUMMARY OF THE INVENTION

Specifically, the present invention provides for isolated nucleic acid molecules encoding FOS-related polypeptides comprising the nucleotide sequences found in SEQ ID NOS: 1-172 (it being understood that nucleic acids are given in odd-numbered sequence ID numbers only for SEQ ID NOS: 1-172, while amino acid sequences are given in even numbers of SEQ ID NOS:1-172), and isolated nucleic acid molecules encoding the amino acid sequences found in SEQ ID NOS: 1-172. Further provided are isolated nucleic acid molecules comprising the nucleotide sequences found in SEQ ID NOS: 173, 174, 175, 353 and 354. Also provided are isolated or recombinant polypeptides having an amino acid sequence encoded by a nucleic acid molecule described herein. Variant nucleic acid molecules and polypeptides sufficiently identical to the nucleotide and amino acid sequences set forth in the sequence listings are encompassed by the present invention. Additionally, fragments and sufficiently identical fragments of the nucleotide and amino acid sequences are encompassed. Nucleotide sequences that are complementary to a nucleotide sequence of the invention, or that hybridize to a sequence of the invention are also encompassed.

The nucleotide sequences of the present invention provided in odd SEQ ID NOS:1-172 include non-coding region upstream of the start site. Therefore, nucleotide sequences comprising the coding region of odd SEQ ID NOS:1-172 are also provided. The coding region may be identified by reviewing the sequence listing, specifically odd SEQ ID NOS:1-172, where the amino acid translation provided beneath the nucleotide sequence is indicative of the coding portion.

Compositions further include vectors and host cells for recombinant expression of the nucleic acid molecules described herein, as well as transgenic microbial populations comprising the vectors. Also included in the invention are methods for the recombinant production of the polypeptides of the invention, and methods for their use. Further are included methods and kits for detecting the presence of a nucleic acid or polypeptide sequence of the invention in a sample, and antibodies that bind to a polypeptide of the invention.

Nucleic acids of the present invention are useful for imparting better FOS-utilizing capacity to probiotic bacteria such as other lactic acid bacteria, including other *Lactobacillus* species, particularly those that do not otherwise utilize FOS (or other FOS-related compounds). Enhanced FOS-utilizing capacity in such probiotic bacteria is useful for enhancing the ability of such probiotic bacteria to compete with, colonize, or maintain their population position with respect to other bacteria in the gastrointestinal tract of subjects to whom prebiotics are fed, and to whom probiotic bacteria are administered. In addition, the nucleic acids of the present invention are useful as probes in screening other bacteria for the ability to utilize FOS. Other bacteria (particularly lactic acid bacteria and most particularly other species of genus *Lactobacillus*) found to carry FOS-related sequences like those of the present invention, as identified by probes of the present invention, are useful as probiotic bacteria for administration to human or animal subjects.

BRIEF DESCRIPTION OF THE DRAWINGS

FIG. 2A. Transcriptional induction of the msmE, and bfrA genes, monitored by RT-PCR (top) and RNA slot blots (bottom). Cells were grown on glucose (Glc), fructose (Fru), sucrose (Suc), FOS $GF_n$, and FOS $F_n$. Chromosomal DNA was used as a positive control for the probe. FIG. 2B. Transcriptional repression analysis of msmE and bfrA by variable levels of glucose (Glc) and fructose (Fru): 0.1% (5.5 mM), 0.5% (28 mM) and 1.0% (55 mM), in the presence of 1% $F_n$. Cells were grown in the presence of $F_n$ until $OD_{600nm}$ approximated 0.5-0.6, glucose was added and cells were propagated for an additional 30 minutes.

FIG. 3. Growth curves. The two mutants, bfrA (top) and msmE (bottom) were grown on semi-synthetic medium supplemented with 0.5% w/v carbohydrate: fructose (●), GFn (○), Fn (▼), Fn for one passage (■). The lacZ mutant grown on Fn was used as control (∇).

FIG. 4. Operon architecture analysis. A. Alignment of the msm locus from selected bacteria. Regulators, white; α-galactosidases, blue; ABC transporters, gray; fructosidases, yellow; sucrose phosphorylase, red. B. Alignment of the sucrose locus from selected microbes. Regulators, white; fructosidases, yellow; PTS transporters, green; fructokinase, purple; putative proteins, black.

FIG. 7. Mutant growth on select carbohydrates. Strains were grown overnight (18 hours) on semi-synthetic medium supplemented with 0.5% w/v carbohydrates, either glucose (Glc), fructose (Fru), sucrose (Suc), FOS-GFn (GFn), FOS-Fn from Orafti (Fn), FOS-Fn from Rhone-Poulenc (FnRP), lactose (Lac), or galactose (Gal). Cell counts obtained after one passage of the bfrA mutant on FOS-Fn are shown in the lower graph.

FIGS. 8A & 8B. Motifs highly conserved amongst repressors and fructosidases. FIG. 8A, conserved helix-turn-helix motif of the regulators, * the consensus sequence was obtained from Nguyen et al., 1995 (26); FIG. 8B, conserved motifs of the β-fructosidases.

DETAILED DESCRIPTION

Figure 1:
FIG. 1. Operon layout. The region upstream (SEQ ID NO:355) of msmE is shown. The start and stop codons are in bold, the putative ribosome binding site is boxed, and the cre-like elements are underlined. Terminators are indicated by hairpin structures.

The present invention relates to fructo-oligosaccharide (FOS)-related molecules from *Lactobacillus acidophilus*. Nucleotide and amino acid sequences of the molecules are provided. The sequences find use in modifying organisms to have enhanced benefits.

By "FOS-related molecules" is intended "FOS-utilization molecules" and "FOS-induced molecules." By "FOS-utilization molecules" is intended a protein that facilitates the utilization of a fructo-oligosaccharide (FOS) by a cell in any way, including but not limited to metabolic or catabolic pathway molecules that catalyze the splitting of fructo-oligosaccharides or components thereof into smaller saccharides for further utilization by the cell in energy pathways; a transport protein that facilitates the transport of a fructo-oligosaccharide into the cell for further metabolic utilization, etc. FOS-utilization molecules can be found, for example, in SEQ ID NOS:1, 3, 5, 7, 9, and 11. By "FOS-induced molecules" is intended molecules that are induced during FOS-utilization. The FOS-related molecules of the present invention include, in general, protein molecules from *L. acidophilus*, and variants and fragments thereof. The FOS-related molecules include the nucleic acid molecules listed in Table 1 and the polypeptides encoded by them.

These novel FOS-related proteins include transport system proteins, including ATP-binding proteins, solute-binding proteins, and ABC transporters; sucrose phosphorylases; transcriptional repressors; phosphoribosylglycinamide synthetases (GARS); ribosomal proteins; elongation factor proteins; kinases; ATPases; transferases; isomerases; dehydrogenases; aldolases; ligases; peptidases; synthases; phosphatases; and DNA binding proteins.

As used herein, the terms "gene" and "recombinant gene" refer to nucleic acid molecules comprising an open reading frame (ORF), particularly those encoding a FOS-related protein. Isolated nucleic acid molecules of the present invention comprise nucleic acid sequences encoding FOS-related proteins, nucleic acid sequences encoding the amino acid sequences set forth in SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, and 172 (hereinafter designated "even SEQ ID NOS:1-172"), the nucleic acid sequences set forth in SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, and 171 (hereinafter designated "odd SEQ ID NOS: 1-172"), and variants and fragments thereof. Isolated nucleic acid molecules of the present invention also comprise nucleic acid sequences set forth in SEQ ID NOS:173, 174, 175, 353 and 354. The present invention also encompasses antisense nucleic acid molecules, as described below.

In addition, isolated polypeptides and proteins encoded by the nucleotide sequences set forth, and variants and fragments thereof, are encompassed, as well as methods for producing those polypeptides. For purposes of the present invention, the terms "protein" and "polypeptide" are used interchangeably. The polypeptides of the present invention have FOS-utilization activity. FOS-utilization activity refers to a biological or functional activity as determined in vivo or in vitro according to standard assay techniques (see, for example, Example 1). In one embodiment, the activity is catalyzing the splitting of fructooligosaccharides into smaller saccharides. In another embodiment, the activity is transport of fructooligosaccharides into cells carrying the FOS-related molecule.

In a third embodiment, the promoter sequence (SEQ ID NO:173) or fragments thereof (e.g., but not limited to SEQ ID NOS:353 and 354), or nucleic acid sequences comprising at least one of the catabolite response element (cre) sequences found in SEQ ID NOS:174 and 175 can be employed for controlled expression of heterologous genes and their encoded proteins.

The nucleic acid and protein compositions encompassed by the present invention are isolated or substantially purified. By "isolated" or "substantially purified" is intended that the nucleic acid or protein molecules, or biologically active fragments or variants, are substantially or essentially free from components normally found in association with the nucleic acid or protein in its natural state. Such components include other cellular material, culture media from recombinant production, and various chemicals used in chemically synthesizing the proteins or nucleic acids. Preferably, an "isolated" nucleic acid of the present invention is free of nucleic acid sequences that flank the nucleic acid of interest in the genomic DNA of the organism from which the nucleic acid was derived (such as coding sequences present at the 5' or 3' ends). However, the molecule may include some additional bases or moieties that do not deleteriously affect the basic characteristics of the composition. For example, in various embodiments, the isolated nucleic acid contains less than 5 kb, 4 kb, 3 kb, 2 kb, 1 kb, 0.5 kb, or 0.1 kb of nucleic acid sequence normally associated with the genomic DNA in the cells from which it was derived. Similarly, a substantially purified protein has less than about 30%, 20%, 10%, 5%, or 1% (by dry weight) of contaminating protein, or non-FOS-related protein. When the protein is recombinantly produced, preferably culture medium represents less than 30%, 20%, 10%, or 5% of the volume of the protein preparation, and when the protein is produced chemically, preferably the preparations have less than about 30%, 20%, 10%, or 5% (by dry weight) of chemical precursors, or non-FOS-related chemicals.

The compositions and methods of the present invention can be used to modulate the function of the FOS-related molecules of *L. acidophilus*. By "modulate", "alter", or "modify" is intended the up- or down-regulation of a target activity. Proteins of the invention are useful in modifying the abilities of lactic acid bacteria, and also in modifying the nutritional or health-promoting characteristics of foods fermented by such bacteria. Nucleotide molecules of the invention are useful in modulating protein expression by lactic acid bacteria. Up- or down-regulation of expression from a polynucleotide of the present invention is encompassed. Up-regulation may be accomplished by providing multiple gene copies, modulating expression by modifying regulatory elements, promoting transcriptional or translational mechanisms, or other means. Down-regulation may be accomplished by using known antisense and gene silencing techniques.

By "lactic acid bacteria" is intended bacteria from a genus selected from the following: *Aerococcus, Carnobacterium, Enterococcus, Lactococcus, Lactobacillus, Leuconostoc, Oenococcus, Pediococcus, Streptococcus, Melissococcus, Alloiococcus, Dolosigranulum, Lactosphaera, Tetragenococcus, Vagococcus,* and *Weissella* (Holzapfel et al. (2001) *Am. J. Clin. Nutr.* 73:365 S-373 S; Bergey's Manual of Systematic Bacteriology, Vol 2. 1986. Williams and Wilkins, Baltimore. pp 1075-1079).

By "*Lactobacillus*" is meant any bacteria from the genus *Lactobacillus*, including but not limited to *L. casei, L. rhamnosus, L. johnsonni, L. gasseri, L. acidophilus, L. plantarum, L. fermentum, L. salivarius, L. bulgaricus,* and numerous other species outlined by Wood et al. (Holzapfel, W. H. N. The Genera of Lactic Acid Bacteria, Vol. 2. 1995. Brian J. B. Wood, Ed. Aspen Publishers, Inc.)

The polypeptides of the present invention or microbes expressing them are useful as nutritional additives or supplements, and as additives in dairy and fermentation processing. The polynucleotide sequences, encoded polypeptides and microorganisms expressing them are useful in the manufacture of milk-derived products, such as cheeses, yogurt, fermented milk products, sour milks and buttermilk. Microorganisms that express polypeptides of the invention may be probiotic organisms. By "probiotic" is intended a live microorganism that survives passage through the gastrointestinal tract and has a beneficial effect on the subject. By "subject" is intended a living organism that comes into contact with a microorganism expressing a protein of the present invention. Subject may refer to humans and other animals.

The polynucleotides and polypeptides of the present invention are useful in modifying milk-derived products. These uses include, but are not limited to, enhancing the ability of bacteria to colonize the gastrointestinal tract of a subject, stimulating the growth of beneficial commensal bacteria residing in the gastrointestinal tract, and altering the products produced during fermentation of FOS compounds.

The nucleic acid molecules of the invention encode FOS-related proteins having the amino acid sequences set forth in even SEQ ID NOS:1-172.

In addition to the FOS-related nucleotide sequences disclosed herein, and fragments and variants thereof, the isolated nucleic acid molecules of the current invention also encompass homologous DNA sequences identified and isolated from other organisms or cells by hybridization with entire or partial sequences obtained from the FOS-related nucleotide sequences disclosed herein, or variants and fragments thereof.

Fragments and Variants

The invention includes isolated nucleic acid molecules comprising nucleotide sequences regulating and encoding FOS-related proteins or variants and fragments thereof, as well as the FOS-related proteins encoded thereby. By "FOS-related protein" is intended proteins having the amino acid sequences set forth in even SEQ ID NOS:1-172, as well as fragments, biologically active portions, and variants thereof. By "fragment" of a nucleotide or protein is intended a portion of the nucleotide or amino acid sequence.

Fragments of nucleic acid molecules can be used as hybridization probes to identify FOS-related-protein-encoding nucleic acids, or can be used as primers in PCR amplification or mutation of FOS-related nucleic acid molecules. Fragments of nucleic acids can also be bound to a physical substrate to comprise what may be considered a macro- or microarray (see, for example, U.S. Pat. No. 5,837,832; U.S. Pat. No. 5,861,242; WO 89/10977; WO 89/11548; WO 93/17126; U.S. Pat. No. 6,309,823). Such arrays of nucleic acids may be used to study gene expression or to identify nucleic acid molecules with sufficient identity to the target sequences. By "nucleic acid molecule" is intended DNA molecules (e.g., cDNA or genomic DNA) and RNA molecules (e.g., mRNA) and analogs of the DNA or RNA generated using nucleotide analogs. The nucleic acid molecule can be single-stranded or double-stranded, but preferably is double-stranded DNA. A nucleotide fragment of a FOS-related protein may encode a protein fragment that is biologically active, or it may be used as a hybridization probe or PCR primer as described below. A biologically active nucleotide fragment can be prepared by isolating a portion of one of the nucleotide sequences of the invention, expressing the encoded portion of the FOS-related protein (e.g., by recombinant expression in vitro), and assessing the activity of the encoded portion of the FOS-related protein. Fragments of FOS-related nucleic acid molecules comprise at least about 15, 20, 50, 75, 100, 200, 250, 300, 350, 400, 450, 500, 550, 600, 650, 700, 750, 800, 850, 900, 950, 1000 nucleotides or up to the total number of nucleotides present in a full-length FOS-related nucleotide sequence as disclosed herein. (For example, 1314 for SEQ ID NO:1, 960 for SEQ ID NO:3, etc.).

Fragments of the nucleotide sequences of the present invention will encode protein fragments that retain the biological activity of the FOS-related protein and, hence, retain FOS-utilization protein activity. By "retains activity" is intended that the fragment will have at least about 30%, preferably at least about 50%, more preferably at least about 70%, even more preferably at least about 80% of the activity of the FOS-related protein disclosed in even SEQ ID NOS: 1-172. Methods for measuring FOS-utilization activity are well known in the art. See, for example, the Example section below as well as the section entitled "Methods of Use" for examples of functional assays.

Fragments of amino acid sequences include polypeptide fragments suitable for use as immunogens to raise anti-FOS-related antibodies. Fragments include peptides comprising amino acid sequences sufficiently identical to or derived from the amino acid sequence of a FOS-related protein, or partial-length protein, of the invention and exhibiting at least one activity of a FOS-related protein, but which include fewer amino acids than the full-length FOS-related proteins disclosed herein. Typically, biologically active portions comprise a domain or motif with at least one activity of the FOS-related protein. A biologically active portion of a FOS-related protein can be a polypeptide which is, for example, 10, 25, 50, 100, 150, 200 contiguous amino acids in length, or up to the total number of amino acids present in a full-length FOS-related protein of the current invention. (For example, 415 for SEQ ID NO:2, 294 for SEQ ID NO:4, etc.). Such biologically active portions can be prepared by recombinant techniques and evaluated for one or more of the functional activities of a native FOS-related protein. As used here, a fragment comprises at least 5 contiguous amino acids of any of even SEQ ID NOS:1-172. The invention encompasses other fragments, however, such as any fragment in the protein greater than 6, 7, 8, or 9 amino acids.

Variants of the nucleotide and amino acid sequences are encompassed in the present invention. By "variant" is intended a sufficiently identical sequence. Accordingly, the invention encompasses isolated nucleic acid molecules that are sufficiently identical to the nucleotide sequences encoding FOS-related proteins in even SEQ ID NOS:1-172, or nucleic acid molecules that hybridize to a nucleic acid molecule of odd SEQ ID NOS:1-172, or a complement thereof, under stringent conditions. Variants also include polypeptides encoded by the nucleotide sequences of the present invention. In addition, polypeptides of the current invention have an amino acid sequence that is sufficiently identical to an amino acid sequence put forth in even SEQ ID NOS:1-172. By "sufficiently identical" is intended that one amino acid or nucleotide sequence contains a sufficient or minimal number of equivalent or identical amino acid residues as compared to a second amino acid or nucleotide sequence, thus providing a common structural domain and/or indicating a common functional activity. Conservative variants include those sequences that differ due to the degeneracy of the genetic code.

In general, amino acids or nucleotide sequences that have at least about 45%, 55%, or 65% identity, preferably about 70% or 75% identity, more preferably about 80%, 85% or 90%, most preferably about 91%, 92%, 93%, 94%, 95%, 96%, 97%, 98%, or 99% sequence identity to any of the amino acid sequences of even SEQ ID NOS:1-172 or any of the nucleotide sequences of odd SEQ ID NOS:1-172, respectively, using one of the alignment programs described herein using standard parameters. One of skill in the art will recognize that these values can be appropriately adjusted to determine corresponding identity of proteins encoded by two nucleotide sequences by taking into account codon degeneracy, amino acid similarity, reading frame positioning, and the like.

Variant proteins encompassed by the present invention are biologically active, that is they continue to possess the desired biological activity of the native protein, that is, FOS-utilization activity as described herein. By "retains activity" is intended that the variant will have at least about 30%, preferably at least about 50%, more preferably at least about 70%, even more preferably at least about 80% of the activity of the FOS-related protein disclosed in even SEQ ID NOS:1-172. Methods for measuring FOS-utilization activity are well known in the art. See, for example, the Example section below as well as the section entitled "Methods of Use" for examples of functional assays. A biologically active variant of a protein of the invention may differ from that protein by as few as 1-15 amino acid residues, as few as 1-10, such as 6-10, as few as 5, as few as 4, 3, 2, or even 1 amino acid residue.

Naturally occurring variants may exist within a population (e.g., the *L. acidophilus* population). Such variants can be identified by using well-known molecular biology techniques, such as the polymerase chain reaction (PCR), and hybridization as described below. Synthetically derived nucleotide sequences, for example, sequences generated by site-directed mutagenesis or PCR-mediated mutagenesis which still encode a FOS-related protein, are also included as variants. One or more nucleotide or amino acid substitutions, additions, or deletions can be introduced into a nucleotide or amino acid sequence disclosed herein, such that the substitutions, additions, or deletions are introduced into the encoded protein. The additions (insertions) or deletions (truncations) may be made at the N-terminal or C-terminal end of the native protein, or at one or more sites in the native protein. Similarly, a substitution of one or more nucleotides or amino acids may be made at one or more sites in the native protein.

For example, conservative amino acid substitutions may be made at one or more predicted, preferably nonessential amino acid residues. A "nonessential" amino acid residue is a residue that can be altered from the wild-type sequence of a protein without altering the biological activity, whereas an "essential" amino acid is required for biological activity. A "conservative amino acid substitution" is one in which the amino acid residue is replaced with an amino acid residue with a similar side chain. Families of amino acid residues having similar side chains are known in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Such substitutions would not be made for conserved amino acid residues, or for amino acid residues residing within a conserved motif, where such residues are essential for protein activity.

Alternatively, mutations can be made randomly along all or part of the length of the FOS-related coding sequence, such as by saturation mutagenesis. The mutants can be expressed recombinantly, and screened for those that retain biological activity by assaying for FOS-related activity using standard assay techniques. Methods for mutagenesis and nucleotide sequence alterations are known in the art. See, for example, Kunkel (1985) *Proc. Natl. Acad. Sci. USA* 82:488-492; Kunkel et al. (1987) *Methods in Enzymol. Molecular Biology* (MacMillan Publishing Company, New York) and the references sited therein. Obviously the mutations made in the DNA encoding the variant must not disrupt the reading frame and preferably will not create complimentary regions that could produce secondary mRNA structure. See, EP Patent Application Publication No. 75,444. Guidance as to appropriate amino acid substitutions that do not affect biological activity of the protein of interest may be found in the model of Dayhoff et al. (1978) *Atlas of Protein Sequence and Structure* (Natl. Biomed. Res. Found., Washington, D.C.), herein incorporated by reference.

The deletions, insertions, and substitutions of the protein sequences encompassed herein are not expected to produce radical changes in the characteristics of the protein. However, when it is difficult to predict the exact effect of the substitution, deletion, or insertion in advance of doing so, one skilled in the art will appreciate that the effect will be evaluated by routine screening assays. That is, the activity can be evaluated by comparing the activity of the modified sequence with the activity of the original sequence.

Variant nucleotide and amino acid sequences of the present invention also encompass sequences derived from mutagenic and recombinogenic procedures such as DNA shuffling. With such a procedure, one or more different FOS-related protein coding regions can be used to create a new FOS-related protein possessing the desired properties. In this manner, libraries of recombinant polynucleotides are generated from a population of related sequence polynucleotides comprising sequence regions that have substantial sequence identity and can be homologously recombined in vitro or in vivo. For example, using this approach, sequence motifs encoding a domain of interest may be shuffled between the FOS-related gene of the invention and other known FOS-related genes to obtain a new gene coding for a protein with an improved property of interest, such as an increased $K_m$ in the case of an enzyme. Strategies for such DNA shuffling are known in the art. See, for example, Stemmer (1994) *Proc. Natl. Acad. Sci. USA* 91:10747-10751; Stemmer (1994) *Nature* 370:389-391; Crameri et al. (1997) *Nature Biotech.* 15:436-438; Moore et al. (1997) *J. Mol. Biol.* 272:336-347; Zhang et al. (1997) *Proc. Natl. Acad. Sci. USA* 94:4504-4509; Crameri et al. (1998) *Nature* 391:288-291; and U.S. Pat. Nos. 5,605,793 and 5,837,458.

Variants of the FOS-related proteins can function as either FOS-related agonists (mimetics) or as FOS-related antagonists. An agonist of the FOS-related protein can retain substantially the same, or a subset, of the biological activities of the naturally occurring form of the FOS-related protein. An antagonist of the FOS-related protein can inhibit one or more of the activities of the naturally occurring form of the FOS-related protein by, for example, competitively binding to a downstream or upstream member of a cellular signaling cascade that includes the FOS-related protein.

Variants of a FOS-related protein that function as either agonists or antagonists can be identified by screening combinatorial libraries of mutants, e.g., truncation mutants, of a FOS-related protein for FOS-related protein agonist or antagonist activity. In one embodiment, a variegated library of FOS-related variants is generated by combinatorial mutagenesis at the nucleic acid level and is encoded by a variegated gene library. A variegated library of FOS-related variants can be produced by, for example, enzymatically ligating a mixture of synthetic oligonucleotides into gene sequences such that a degenerate set of potential FOS-related sequences is expressible as individual polypeptides, or alternatively, as a set of larger fusion proteins (e.g., for phage display) containing the set of FOS-related sequences therein. There are a variety of methods that can be used to produce libraries of potential FOS-related variants from a degenerate oligonucleotide sequence. Chemical synthesis of a degenerate gene sequence can be performed in an automatic DNA synthesizer, and the synthetic gene then ligated into an appropriate expression vector. Use of a degenerate set of genes allows for the provision, in one mixture, of all of the sequences encoding the desired set of potential FOS-related sequences. Methods for synthesizing degenerate oligonucleotides are known in the art (see, e.g., Narang (1983) *Tetrahedron* 39:3; Itakura et al. (1984) *Annu. Rev. Biochem.* 53:323; Itakura et al. (1984) *Science* 198:1056; Ike et al. (1983) *Nucleic Acid Res.* 11:477).

In addition, libraries of fragments of a FOS-related protein coding sequence can be used to generate a variegated population of FOS-related fragments for screening and subsequent selection of variants of a FOS-related protein. In one embodiment, a library of coding sequence fragments can be generated by treating a double-stranded PCR fragment of a FOS-related coding sequence with a nuclease under conditions wherein nicking occurs only about once per molecule, denaturing the double-stranded DNA, renaturing the DNA to form double-stranded DNA which can include sense/antisense pairs from different nicked products, removing single-stranded portions from reformed duplexes by treatment with S1 nuclease, and ligating the resulting fragment library into an expression vector. By this method, one can derive an expression library that encodes N-terminal and internal fragments of various sizes of the FOS-related protein.

Several techniques are known in the art for screening gene products of combinatorial libraries made by point mutations or truncation and for screening cDNA libraries for gene products having a selected property. Such techniques are adaptable for rapid screening of the gene libraries generated by the combinatorial mutagenesis of FOS-related proteins. The most widely used techniques, which are amenable to high through-put analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a technique that enhances the frequency of functional mutants in the libraries, can be used in combination with the screening assays to identify FOS-related variants (Arkin and Yourvan (1992) *Proc. Natl. Acad. Sci. USA* 89:7811-7815; Delgrave et al. (1993) *Protein Engineering* 6(3):327-331).

Regulatory Sequences

It will be appreciated that an embodiment of the present invention provides isolated DNAs that encode regulatory elements comprising the nucleotide sequences set forth in SEQ ID NO:173, 353 and 354, and isolated nucleic acid molecules comprising one or both of the cre elements provided in SEQ ID NOS:174 and 175. By "regulatory element" or "regulatory nucleotide sequence" as used herein is any DNA sequence that regulates nucleic acid expression at the transcriptional level (i.e., activates and/or suppresses), and is intended to include controllable transcriptional promoters, operators, enhancers, transcriptional terminators, and other expression control elements such as translational control sequences (e.g., Shine-Dalgarno consensus sequence, initiation and termination codons). By "promoter" is intended a regulatory region of DNA, generally comprising a TATA box that is capable of directing RNA polymerase II to initiate RNA synthesis at the appropriate transcription initiation site for a given coding sequence. A promoter may also comprise other recognition sequences, generally positioned upstream or 5' to the TATA box, referred to as upstream promoter elements. It is recognized that having identified the nucleotide sequences for the regulatory or promoter regions disclosed herein, it is within the ability of one skilled in the art to isolate and identify additional regulatory elements in the 5' untranslated region from the particular regulatory or promoter regions identified herein. By "catabolite responsive element," "cre sequence" or "cre-like sequence" is intended a cis-acting DNA sequence involved in catabolite repression. The regulatory elements disclosed herein that activate transcription of the nucleic acids, increase nucleic acid transcription by at least 50%, more preferably by at least 100%, 150%, 200%, or even 300%, regulatory elements disclosed herein that suppress transcription of the nucleic acids do so by at least 25%, more preferably by at least 35%, 50%, 60%, 75%, or even 85%, or more.

Regulatory elements (SEQ ID NO:173, 353 and 354) of the present invention are located within the approximately 0.2 kb of DNA 5' to the msmE gene (SEQ ID NO:1) and is part of the 5' UTR of the msmE gene. It will be apparent that other sequence fragments from SEQ ID NO:173, longer or shorter than the foregoing sequence, e.g., including, but not limited to one or both of the cre sequences of SEQ ID NOS:174 and 175, SEQ ID NOS: 353 and 354, or with minor additions, deletions, or substitutions made thereto, as those that result from site-directed mutagenesis, as well as synthetically derived sequences, can be prepared which will also carry the FOS-related regulatory element, all of which are included within the present invention.

In one preferred embodiment of the invention, the isolated DNA encoding the regulatory element has the sequence given as SEQ ID NO:173, 353 or 354. In other preferred embodiments, the sequence of the isolated DNA encoding the regulatory element corresponds to a continuous segment of DNA within the DNA given as SEQ ID NO:173, 353 or 354, including but not limited to the continuous segment given as nucleotides 1 to 249 of SEQ ID NO:173, 1 to 204 of SEQ ID NO:353, and 1 to 198 of SEQ ID NO:354. Nucleic acid molecules that are fragments of a promoter or regulatory nucleotide sequence comprise at least 15, 20, 25, 30, 35, 40, 45, 50, 75, 100, 150, 200 nucleotides, or up to the number of nucleotides present in the full-length regulatory nucleotide sequence disclosed herein (i.e., 249 for SEQ ID NO:173, 204 for SEQ ID NO:353, and 198 for SEQ ID NO:354). Fragments of a promoter sequence that retain their regulatory activity comprise at least 30, 35, 40 contiguous nucleotides, preferably at least 50 contiguous nucleotides, more preferably at least 75 contiguous nucleotides, still more preferably at least 100 contiguous nucleotides of the particular promoter or regulatory nucleotide sequence disclosed herein. Preferred fragment lengths depend upon the objective and will also vary depending upon the particular promoter or regulatory sequence.

The nucleotides of such fragments will usually comprise the TATA recognition sequence of the particular promoter sequence. Such fragments may be obtained by use of restriction enzymes to cleave the naturally occurring promoter nucleotide sequence disclosed herein; by synthesizing a nucleotide sequence from the naturally occurring sequence of the promoter DNA sequence; or may be obtained through the use of PCR technology. See, for example, Mullis et al. (1987) *Methods Enzymol.* 155:335-350, and Erlich, ed. (1989) *PCR Technology* (Stockton Press, New York). Variants of these promoter fragments, such as those resulting from site-directed mutagenesis, are also encompassed by the compositions of the present invention.

Regulatory elements of the present invention include DNA molecules that regulate expression of nucleic acids encoding FOS-related molecules and have sequences that are substantially homologous to the DNA sequences comprising the regulatory elements disclosed herein, and particularly the regulatory elements disclosed herein as SEQ ID NOS:173, 353 and 354. Regulatory elements of the present invention also encompass DNA molecules that regulate expression of nucleic acids encoding FOS-related molecules and have sequences that are substantially homologous to DNA sequences located within SEQ ID NO:173, 353 and 354. This definition is intended to include natural variations in the DNA sequence comprising the regulatory element and sequences within SEQ ID NO:173, 353 and 354. As used herein, two regions of nucleotide sequences or polypeptides that are considered "substantially homologous" when they are at least about 50%, 60%, to 70%, generally at least about 75%, preferably at least about 80%, 85%, 90%, 91%, 92%, 93%, 94%, 95%, 96%, 97%, 98% or 99% sequence homology.

Regulatory elements include those which are at least about 75 percent homologous (and more preferably 80%, 85%, 90%, 91%, 92%, 93%, 94%, 95%, 96%, 97%, 98% or even 99% homologous) to the regulatory elements disclosed herein, in particular the regulatory element having the sequence given herein as SEQ ID NO:173, 353 and 354 and which are capable of regulating the transcription of nucleic acids encoding FOS-related molecules. Regulatory elements from other species also include those which are at least about 75 percent homologous (and more preferably 80%, 85%, 90% or even 95% homologous) to a continuous segment of the regulatory elements as defined herein as SEQ ID NO:173, 353 and 354, and which are capable of regulating the transcription of nucleic acids encoding FOS-related molecules, including but not limited to the continuous segment given herein as nucleotides 1 to 249 of SEQ ID NO:173, nucleotides 1 to 204 of SEQ ID NO:353, and nucleotides 1 to 198 of SEQ ID NO:354.

The present invention also provides recombinant DNAs comprising a regulatory element operably associated with heterologous DNA. The regulatory element is operably associated with the heterologous DNA such that the regulatory element is functionally linked to the heterologous DNA, and can thereby alter transcription of the heterologous DNA. Typically, the regulatory element will be located 5' to the heterologous DNA, but it may also be located 3' to the heterologous DNA as long as it is operably associated therewith.

There are no particular upper or lower limits as to the distance between the regulatory element and the heterologous DNA, as long as the two DNA segments are operably associated with each other The heterologous DNA segment may encode any protein or peptide which is desirably expressed by the host cell. Typically, the heterologous DNA includes regulatory segments necessary for the expression of the protein or peptide in the host cell (i.e, promoter elements). Suitable heterologous DNA may be of prokaryotic or eukaryotic origin. Illustrative proteins and peptides encoded by the heterologous DNAs of the present invention include enzymes, hormones, growth factors, and cytokines. Preferably, the heterologous DNA encodes a FOS-related protein.

Alternatively, the heterologous DNA can be used to express antisense RNAs. In general, "antisense" refers to the use of small, synthetic oligonucleotides to inhibit gene expression by inhibiting the function of the target mRNA containing the complementary sequence. Milligan, J. F. et al., J. Med. Chem. 36(14), 1923-1937 (1993). Gene expression is inhibited through hybridization to coding (sense) sequences in a specific mRNA target by hydrogen bonding according to Watson-Crick base pairing rules. The mechanism of antisense inhibition is that the exogenously applied oligonucleotides decrease the mRNA and protein levels of the target gene. Milligan, J. F. et al., J. Med. Chem. 36(14), 1923-1937 (1993). See also Helene, C. and Toulme, J., Biochim. Biophys. Acta 1049, 99-125 (1990); Cohen, J. S., Ed., OLIGODEOXYNUCLEOTIDES AS ANTISENSE INHIBITORS OF GENE EXPRESSION, CRC Press: Boca Raton, Fla. (1987).

As described above for the FOS-related sequences, the regulatory nucleotide sequences of the invention can be used to isolate other homologous sequences in other species. In these techniques all or part of the known promoter is used as a probe, which selectively hybridizes to other promoters present in a population of cloned genomic DNA fragments or cDNA fragments (i.e., genomic or cDNA libraries) from a chosen organism.

Sequence Identity

The FOS-related sequences are members of multiple families of molecules, with conserved functional features. By "family" is intended two or more proteins or nucleic acid molecules having sufficient nucleotide or amino acid sequence identity. A family that contains deeply divergent groups may be divided into subfamilies. A clan is a group of families that are thought to have common ancestry. Members of a clan often have a similar tertiary structure.

By "sequence identity" is intended the nucleotide or amino acid residues that are the same when aligning two sequences for maximum correspondence over a specified comparison window. By "comparison window" is intended a contiguous segment of the two nucleotide or amino acid sequences for optimal alignment, wherein the second sequence may contain additions or deletions (i.e., gaps) as compared to the first sequence. Generally, for nucleic acid alignments, the comparison window is at least 20 contiguous nucleotides in length, and optionally can be 30, 40, 50, 100, or longer. For amino acid sequence alignments, the comparison window is at least 6 contiguous amino acids in length, and optionally can be 10, 15, 20, 30, or longer. Those of skill in the art understand that to avoid a high similarity due to inclusion of gaps, a gap penalty is typically introduced and is subtracted from the number of matches.

Family members may be from the same or different species, and can include homologues as well as distinct proteins.

Often, members of a family display common functional characteristics. Homologues can be isolated based on their identity to the L. acidophilus FOS-related nucleic acid sequences disclosed herein using the cDNA, or a portion thereof, as a hybridization probe according to standard hybridization techniques under stringent hybridization conditions as disclosed below.

To determine the percent identity of two amino acid or nucleotide sequences, an alignment is performed. Percent identity of the two sequences is a function of the number of identical residues shared by the two sequences in the comparison window (i.e., percent identity=number of identical residues/total number of residues×100). In one embodiment, the sequences are the same length. Methods similar to those mentioned below can be used to determine the percent identity between two sequences. The methods can be used with or without allowing gaps. Alignment may also be performed manually be inspection.

When amino acid sequences differ in conservative substitutions, the percent identity may be adjusted upwards to correct for the conservative nature of the substitution. Means for making this adjustment are known in the art. Typically the conservative substitution is scored as a partial, rather than a full mismatch, thereby increasing the percentage sequence identity.

Mathematical algorithms can be used to determine the percent identity of two sequences. Non-limiting examples of mathematical algorithms are the algorithm of Karlin and Altschul (1990) Proc. Natl. Acad. Sci. USA 87:2264, modified as in Karlin and Altschul (1993) Proc. Natl. Acad. Sci. USA 90:5873-5877; the algorithm of Myers and Miller (1988) CABIOS 4:11-17; the local alignment algorithm of Smith et al. (1981) Adv. Appl. Math. 2:482; the global alignment algorithm of Needleman and Wunsch (1970) J. Mol. Biol. 48:443-453; and the search-for-local-alignment method of Pearson and Lipman (1988) Proc. Natl. Acad. Sci. USA 85:2444-2448.

Various computer implementations based on these mathematical algorithms have been designed to enable the determination of sequence identity. The BLAST programs of Altschul et al. (1990) J. Mol. Biol. 215:403 are based on the algorithm of Karlin and Altschul (1990) supra. Searches to obtain nucleotide sequences that are homologous to nucleotide sequences of the present invention can be performed with the BLASTN program, score=100, wordlength=12. To obtain amino acid sequences homologous to sequences encoding a protein or polypeptide of the current invention, the BLASTX program may be used, score=50, wordlength=3. Gapped alignments may be obtained by using Gapped BLAST as described in Altschul et al. (1997) Nucleic Acids Res. 25:3389. To detect distant relationships between molecules, PSI-BLAST can be used. See Altschul et al. (1997) supra. For all of the BLAST programs, the default parameters of the respective programs can be used. See the website at ncbi.nlm.nih.gov Another program that can be used to determine percent sequence identity is the ALIGN program (version 2.0), which uses the mathematical algorithm of Myers and Miller (1988) supra. A PAM120 weight residue table, a gap length penalty of 12, and a gap penalty of 4 can be used with this program when comparing amino acid sequences.

In addition to the ALIGN and BLAST programs, the BESTFIT, GAP, FASTA and TFASTA programs are part of the Wisconsin Genetics Software Package (available from Accelrys Inc., 9685 Scranton Rd., San Diego, Calif., USA), and can be used for performing sequence alignments. The preferred program is GAP version 10, which used the algorithm of Needleman and Wunsch (1970) supra. Unless otherwise stated the sequence identity values provided herein refer to those values obtained by using the GAP program with the following parameters: % identity and % similarity for a nucleotide sequence using GAP Weight of 50 and Length Weight of 3, and the nwsgapdna.cmp scoring matrix; % identity and % similarity for an amino acid sequence using GAP Weight of 8 and Length Weight of 2, and the BLOSUM62 scoring matrix; or any equivalent program thereof. By "equivalent program" is intended any sequence comparison program that, for any two sequences in question, generates an alignment having identical nucleotide or amino acid residue matches and an identical percent sequence identity when compared to the corresponding alignment generated by GAP Version 10.

Identification and Isolation of Homologous Sequences

FOS-related nucleotide sequences identified based on their sequence identity to the FOS-related nucleotide sequences set forth herein, or to fragments and variants thereof, are encompassed by the present invention. Methods such as PCR or hybridization can be used to identify sequences from a cDNA or genomic library, for example, that are substantially identical to the sequence of the invention. See, for example, Sambrook et al. (1989) *Molecular Cloning: Laboratory Manual* (2d ed., Cold Spring Harbor Laboratory Press, Plainview, N.Y.) and Innis, et al. (1990) *PCR Protocols: A Guide to Methods and Applications* (Academic Press, NY). Methods for construction of such cDNA and genomic libraries are generally known in the art and are also disclosed in the above reference.

In hybridization techniques, the hybridization probes may be genomic DNA fragments, cDNA fragments, RNA fragments, or other oligonucleotides, and may consist of all or part of a known nucleotide sequence disclosed herein. In addition, they may be labeled with a detectable group such as $^{32}$P, or any other detectable marker, such as other radioisotopes, a fluorescent compound, an enzyme, or an enzyme co-factor. Probes for hybridization can be made by labeling synthetic oligonucleotides based on the known FOS-related nucleotide sequences disclosed herein. Degenerate primers designed on the basis of conserved nucleotides or amino acid residues in a known FOS-related nucleotide sequence or encoded amino acid sequence can additionally be used. The hybridization probe typically comprises a region of nucleotide sequence that hybridizes under stringent conditions to at least about 10, preferably about 20, more preferably about 50, 75, 100, 125, 150, 175, 200, 250, 300, 350, or 400 consecutive nucleotides of a FOS-related nucleotide sequence of the invention or a fragment or variant thereof. To achieve specific hybridization under a variety of conditions, such probes include sequences that are unique among FOS-related protein sequences. Preparation of probes for hybridization is generally known in the art and is disclosed in Sambrook et al. (1989) *Molecular Cloning: A Laboratory Manual* (2d ed., Cold Spring Harbor Laboratory Press, Plainview, N.Y.), herein incorporated by reference.

In one embodiment the entire nucleotide sequence encoding a FOS-related protein is used as a probe to identify novel FOS-related sequences and messenger RNAs. In another embodiment, the probe is a fragment of a nucleotide sequence disclosed herein. In some embodiments, the nucleotide sequence that hybridizes under stringent conditions to the probe can be at least about 300, 325, 350, 375, 400, 425, 450, 500, 550, 600, 650, 700, 800, 900, 1000, or more nucleotides in length.

Substantially identical sequences will hybridize to each other under stringent conditions. By "stringent conditions" is intended conditions under which a probe will hybridize to its target sequence to a detectably greater degree than to other sequences (e.g., at least 2-fold over background). Generally, stringent conditions encompasses those conditions for hybridization and washing under which nucleotides having at least about 60%, 65%, 70%, preferably 75% sequence identity typically remain hybridized to each other. Stringent conditions are known in the art and can be found in *Current Protocols in Molecular Biology* (John Wiley & Sons, New York (1989)), 6.3.1-6.3.6. Hybridization typically occurs for less than about 24 hours, usually about 4 to about 12 hours.

Stringent conditions are sequence-dependent and will differ in different circumstances. Full-length or partial nucleic acid sequences may be used to obtain homologues and orthologs encompassed by the present invention. By "orthologs" is intended genes derived from a common ancestral gene and which are found in different species as a result of speciation. Genes found in different species are considered orthologs when their nucleotide sequences and/or their encoded protein sequences share substantial identity as defined elsewhere herein. Functions of orthologs are often highly conserved among species.

When using probes, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides).

The post-hybridization washes are instrumental in controlling specificity. The two critical factors are ionic strength and temperature of the final wash solution. For the detection of sequences that hybridize to a full-length or approximately full-length target sequence, the temperature under stringent conditions is selected to be about 5° C. lower than the thermal melting point ($T_m$) for the specific sequence at a defined ionic strength and pH. However, stringent conditions would encompass temperatures in the range of 1° C. to 20° C. lower than the $T_m$, depending on the desired degree of stringency as otherwise qualified herein. For DNA-DNA hybrids, the $T_m$ can be determined using the equation of Meinkoth and Wahl (1984) *Anal. Biochem.* 138:267-284: $T_m$=81.5° C.+16.6 (logM)+0.41 (% GC)−0.61 (% form)−500/L; where M is the molarity of monovalent cations, % GC is the percentage of guanosine and cytosine nucleotides in the DNA, % form is the percentage of formamide in the hybridization solution, and L is the length of the hybrid in base pairs. The $T_m$ is the temperature (under defined ionic strength and pH) at which 50% of a complementary target sequence hybridizes to a perfectly matched probe.

The ability to detect sequences with varying degrees of homology can be obtained by varying the stringency of the hybridization and/or washing conditions. To target sequences that are 100% identical (homologous probing), stringency conditions must be obtained that do not allow mismatching. By allowing mismatching of nucleotide residues to occur, sequences with a lower degree of similarity can be detected (heterologous probing). For every 1% of mismatching, the $T_m$ is reduced about 1° C.; therefore, hybridization and/or wash conditions can be manipulated to allow hybridization of sequences of a target percentage identity. For example, if sequences with ≧90% sequence identity are preferred, the $T_m$ can be decreased by 10° C. Two nucleotide sequences could be substantially identical, but fail to hybridize to each other under stringent conditions, if the polypeptides they encode are substantially identical. This situation could arise, for example, if the maximum codon degeneracy of the genetic code is used to create a copy of a nucleic acid.

Exemplary low stringency conditions include hybridization with a buffer solution of 30-35% formamide, 1 M NaCl, 1% SDS (sodium dodecyl sulfate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1.0 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C. Optionally, wash buffers may comprise about 0.1% to about 1% SDS. Duration of hybridization is generally less than about 24 hours, usually about 4 to about 12 hours. An extensive guide to the hybridization of nucleic acids is found in Tijssen (1993) *Laboratory Techniques in Biochemistry and Molecular Biology—Hybridization with Nucleic Acid Probes*, Part I, Chapter 2 (Elsevier, N.Y.); and Ausubel et al., eds. (1995) *Current Protocols in Molecular Biology*, Chapter 2 (Greene Publishing and Wiley-Interscience, New York). See Sambrook et al. (1989) *Molecular Cloning: A Laboratory Manual* (2d ed., Cold Spring Harbor Laboratory Press, Plainview, N.Y.).

In a PCR approach, oligonucleotide primers can be designed for use in PCR reactions to amplify corresponding DNA sequences from cDNA or genomic DNA extracted from any organism of interest. PCR primers are preferably at least about 10 nucleotides in length, and most preferably at least about 20 nucleotides in length. Methods for designing PCR primers and PCR cloning are generally known in the art and are disclosed in Sambrook et al. (1989) *Molecular Cloning: A Laboratory Manual* (2d ed., Cold Spring Harbor Laboratory Press, Plainview, N.Y.). See also Innis et al., eds. (1990) *PCR Protocols: A Guide to Methods and Applications* (Academic Press, New York); Innis and Gelfand, eds. (1995) *PCR Strategies* (Academic Press, New York); and Innis and Gelfand, eds. (1999) *PCR Methods Manual* (Academic Press, New York). Known methods of PCR include, but are not limited to, methods using paired primers, nested primers, single specific primers, degenerate primers, gene-specific primers, vector-specific primers, partially-mismatched primers, and the like.

Assays

Diagnostic assays to detect expression of the disclosed polypeptides and/or nucleic acid molecules as well as their disclosed activity in a sample are disclosed. An exemplary method for detecting the presence or absence of a disclosed nucleic acid or protein comprising the disclosed polypeptide in a sample involves obtaining a sample from a food/dairy/feed product, starter culture (mother, seed, bulk/set, concentrated, dried, lyophilized, frozen), cultured food/dairy/feed product, dietary supplement, bioprocessing fermentate, or a subject that has ingested a probiotic material, and contacting the sample with a compound or an agent capable of detecting the disclosed polypeptides or nucleic acids (e.g., an mRNA or genomic DNA comprising the disclosed nucleic acid or fragment thereof) such that the presence of the disclosed sequence is detected in the sample. Results obtained with a sample from the food, supplement, culture, product or subject may be compared to results obtained with a sample from a control culture, product or subject.

One agent for detecting the mRNA or genomic DNA comprising a disclosed nucleotide sequence is a labeled nucleic acid probe capable of hybridizing to the disclosed nucleotide sequence of the mRNA or genomic DNA. The nucleic acid probe can be, for example, a disclosed nucleic acid molecule, such as the nucleic acid of odd SEQ ID NOS:1-172, or a portion thereof, such as a nucleic acid molecule of at least 15, 30, 50, 100, 250, or 500 nucleotides in length and sufficient to specifically hybridize under stringent conditions to the mRNA or genomic DNA comprising the disclosed nucleic acid sequence. Other suitable probes for use in the diagnostic assays of the invention are described herein.

One agent for detecting a protein comprising a disclosed polypeptide sequence is an antibody capable of binding to the disclosed polypeptide, preferably an antibody with a detectable label. Antibodies can be polyclonal, or more preferably, monoclonal. An intact antibody, or a fragment thereof (e.g., Fab or F(ab')$_2$) can be used. The term "labeled," with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently labeled secondary antibody and end-labeling of a DNA probe with biotin such that it can be detected with fluorescently labeled streptavidin.

The term "sample" is intended to include tissues, cells, and biological fluids present in or isolated from a subject, as well as cells from starter cultures or food products carrying such cultures, or derived from the use of such cultures. That is, the detection method of the invention can be used to detect mRNA, protein, or genomic DNA comprising a disclosed sequence in a sample both in vitro and in vivo. In vitro techniques for detection of mRNA comprising a disclosed sequence include Northern hybridizations and in situ hybridizations. In vitro techniques for detection of a protein comprising a disclosed polypeptide include enzyme linked immunosorbent assays (ELISAs), Western blots, immunoprecipitations, and immunofluorescence. In vitro techniques for detection of genomic DNA comprising the disclosed nucleotide sequences include Southern hybridizations. Furthermore, in vivo techniques for detection of a protein comprising a disclosed polypeptide include introducing into a subject a labeled antibody against the disclosed polypeptide. For example, the antibody can be labeled with a radioactive marker whose presence and location in a subject can be detected by standard imaging techniques.

In one embodiment, the sample contains protein molecules from a test subject that has consumed a probiotic material. Alternatively, the sample can contain mRNA or genomic DNA from a starter culture.

The invention also encompasses kits for detecting the presence of disclosed nucleic acids or proteins comprising disclosed polypeptides in a sample. Such kits can be used to determine if a microbe expressing a specific polypeptide of the invention is present in a food product or starter culture, or in a subject that has consumed a probiotic material. For example, the kit can comprise a labeled compound or agent capable of detecting a disclosed polypeptide or mRNA in a sample and means for determining the amount of a the disclosed polypeptide in the sample (e.g., an antibody that recognizes the disclosed polypeptide or an oligonucleotide probe that binds to DNA encoding a disclosed polypeptide, e.g., even SEQ ID NOS:1-172). Kits can also include instructions detailing the use of such compounds.

For antibody-based kits, the kit can comprise, for example: (1) a first antibody (e.g., attached to a solid support) that binds to a disclosed polypeptide; and, optionally, (2) a second, different antibody that binds to the disclosed polypeptide or the first antibody and is conjugated to a detectable agent. For oligonucleotide-based kits, the kit can comprise, for example: (1) an oligonucleotide, e.g., a detectably labeled oligonucleotide, that hybridizes to a disclosed nucleic acid sequence or (2) a pair of primers useful for amplifying a disclosed nucleic acid molecule.

The kit can also comprise, e.g., a buffering agent, a preservative, or a protein stabilizing agent. The kit can also comprise components necessary for detecting the detectable agent (e.g., an enzyme or a substrate). The kit can also contain a control sample or a series of control samples that can be assayed and compared to the test sample contained. Each component of the kit is usually enclosed within an individual container, and all of the various containers are within a single package along with instructions for use.

In one embodiment, the kit comprises multiple probes in an array format, such as those described, for example, in U.S. Pat. Nos. 5,412,087, 5,545,531, and PCT Publication No. WO 95/00530, herein incorporated by reference. Probes for use in the array may be synthesized either directly onto the surface of the array, as disclosed in PCT Publication No. WO 95/00530, or prior to immobilization onto the array surface (Gait, ed., *Oligonucleotide synthesis a practical approach*, IRL Press: Oxford, England, 1984). The probes may be immobilized onto the surface using techniques well known to one of skill in the art, such as those described in U.S. Pat. No. 5,412,087. Probes may be a nucleic acid or peptide sequence, preferably purified, or an antibody.

The arrays may be used to screen organisms, samples, or products for differences in their genomic, cDNA, polypeptide or antibody content, including the presence or absence of specific sequences or proteins, as well as the concentration of those materials. Binding to a capture probe is detected, for example, by signal generated from a label attached to the nucleic acid molecule comprising the disclosed nucleic acid sequence, a polypeptide comprising the disclosed amino acid sequence, or an antibody. The method can include contacting the molecule comprising the disclosed nucleic acid, polypeptide, or antibody with a first array having a plurality of capture probes and a second array having a different plurality of capture probes. The results of each hybridization can be compared to analyze differences in expression between a first and second sample. The first plurality of capture probes can be from a control sample, e.g., a wild type lactic acid bacteria, or control subject, e.g., a food, dietary supplement, starter culture sample or a biological fluid. The second plurality of capture probes can be from an experimental sample, e.g., a mutant type lactic acid bacteria, or subject that has consumed a probiotic material, e.g., a starter culture sample or a biological fluid.

These assays may be especially useful in microbial selection and quality control procedures where the detection of unwanted materials is essential. The detection of particular nucleotide sequences or polypeptides may also be useful in determining the genetic composition of food, fermentation products, or industrial microbes, or microbes present in the digestive system of animals or humans that have consumed probiotics.

Antisense Nucleotide Sequences

The present invention also encompasses antisense nucleic acid molecules, i.e., molecules that are complementary to a sense nucleic acid encoding a protein, e.g., complementary to the coding strand of a double-stranded cDNA molecule, or complementary to an mRNA sequence. Accordingly, an antisense nucleic acid can hydrogen bond to a sense nucleic acid. The antisense nucleic acid can be complementary to an entire FOS-related coding strand, or to only a portion thereof, e.g., all or part of the protein coding region (or open reading frame). An antisense nucleic acid molecule can be antisense to a noncoding region of the coding strand of a nucleotide sequence encoding a FOS-related protein. The noncoding regions are the 5' and 3' sequences that flank the coding region and are not translated into amino acids. Antisense nucleotide sequences are useful in disrupting the expression of the target gene. Antisense constructions having 70%, preferably 80%, more preferably 85% sequence identity to the corresponding sequence may be used.

Given the coding-strand sequence encoding a FOS-related protein disclosed herein (e.g., even SEQ ID NOS:1-172), antisense nucleic acids of the invention can be designed according to the rules of Watson and Crick base pairing. The antisense nucleic acid molecule can be complementary to the entire coding region of a FOS-related mRNA, but more preferably is an oligonucleotide that is antisense to only a portion of the coding or noncoding region of a FOS-related mRNA. For example, the antisense oligonucleotide can be complementary to the region surrounding the translation start site of a FOS-related mRNA. An antisense oligonucleotide can be, for example, about 5, 10, 15, 20, 25, 30, 35, 40, 45, or 50 nucleotides in length, or it can be 100, 200 nucleotides, or greater in length. An antisense nucleic acid of the invention can be constructed using chemical synthesis and enzymatic ligation procedures known in the art.

For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, including, but not limited to, for example e.g., phosphorothioate derivatives and acridine substituted nucleotides. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest).

An antisense nucleic acid molecule of the invention can be an α-anomeric nucleic acid molecule. An α-anomeric nucleic acid molecule forms specific double-stranded hybrids with complementary RNA in which, contrary to the usual β-units, the strands run parallel to each other (Gaultier et al. (1987) *Nucleic Acids Res.* 15:6625-6641). The antisense nucleic acid molecule can also comprise a 2'-o-methylribonucleotide (Inoue et al. (1987) *Nucleic Acids Res.* 15:6131-6148) or a chimeric RNA-DNA analogue (Inoue et al. (1987) *FEBS Lett.* 215:327-330).

The invention also encompasses ribozymes, which are catalytic RNA molecules with ribonuclease activity that are capable of cleaving a single-stranded nucleic acid, such as an mRNA, to which they have a complementary region. Ribozymes (e.g., hammerhead ribozymes (described in Haselhoff and Gerlach (1988) *Nature* 334:585-591)) can be used to catalytically cleave FOS-related mRNA transcripts to thereby inhibit translation of FOS-related mRNA. A ribozyme having specificity for a FOS-related-encoding nucleic acid can be designed based upon the nucleotide sequence of a FOS-related cDNA disclosed herein (e.g., odd SEQ ID NOS:1-172). See, e.g., Cech et al., U.S. Pat. No. 4,987,071; and Cech et al., U.S. Pat. No. 5,116,742. Alternatively, FOS-related mRNA can be used to select a catalytic RNA having a specific ribonuclease activity from a pool of RNA molecules. See, e.g., Bartel and Szostak (1993) *Science* 261:1411-1418.

The invention also encompasses nucleic acid molecules that form triple helical structures. For example, FOS-related gene expression can be inhibited by targeting nucleotide sequences complementary to the regulatory region of the FOS-related protein (e.g., the FOS-related promoter and/or enhancers) to form triple helical structures that prevent transcription of the FOS-related gene in target cells. See generally Helene (1991) *Anticancer Drug Des.* 6(6):569; Helene (1992) *Ann. N.Y. Acad. Sci.* 660:27; and Maher (1992) *Bioassays* 14(12):807.

In some embodiments, the nucleic acid molecules of the invention can be modified at the base moiety, sugar moiety, or phosphate backbone to improve, e.g., the stability, hybridization, or solubility of the molecule. For example, the deoxyribose phosphate backbone of the nucleic acids can be modified to generate peptide nucleic acids (see Hyrup et al. (1996) *Bioorganic & Medicinal Chemistry* 4:5). As used herein, the terms "peptide nucleic acids" or "PNAs" refer to nucleic acid mimics, e.g., DNA mimics, in which the deoxyribose phosphate backbone is replaced by a pseudopeptide backbone and only the four natural nucleobases are retained. The neutral backbone of PNAs has been shown to allow for specific hybridization to DNA and RNA under conditions of low ionic strength. The synthesis of PNA oligomers can be performed using standard solid-phase peptide synthesis protocols as described, for example, in Hyrup et al. (1996), supra; Perry-O'Keefe et al. (1996) *Proc. Natl. Acad. Sci. USA* 93:14670.

PNAs can be used as antisense or antigene agents for sequence-specific modulation of gene expression by, e.g., inducing transcription or translation arrest or inhibiting replication. PNAs of the invention can also be used, e.g., in the analysis of single base pair mutations in a gene by, e.g., PNA-directed PCR clamping; as artificial restriction enzymes when used in combination with other enzymes, e.g., S1 nucleases (Hyrup (1996), supra); or as probes or primers for DNA sequence and hybridization (Hyrup (1996), supra; Perry-O'Keefe et al. (1996), supra).

In another embodiment, PNAs of a FOS-related molecule can be modified, e.g., to enhance their stability, specificity, or cellular uptake, by attaching lipophilic or other helper groups to PNA, by the formation of PNA-DNA chimeras, or by the use of liposomes or other techniques of drug delivery known in the art. The synthesis of PNA-DNA chimeras can be performed as described in Hyrup (1996), supra; Finn et al. (1996) *Nucleic Acids Res.* 24(17):3357-63; Mag et al. (1989) *Nucleic Acids Res.* 17:5973; and Peterson et al. (1975) *Bioorganic Med. Chem. Lett.* 5:1119.

Fusion Proteins

The invention also includes FOS-related chimeric or fusion proteins. A FOS-related "chimeric protein" or "fusion protein" comprises a FOS-related polypeptide operably linked to a non-FOS-related polypeptide. A "FOS-related polypeptide" refers to a polypeptide having an amino acid sequence corresponding to a FOS-related protein, whereas a "non-FOS-related polypeptide" refers to a polypeptide having an amino acid sequence corresponding to a protein that is not substantially identical to the FOS-related protein, and which is derived from the same or a different organism. Within a FOS-related fusion protein, the FOS-related polypeptide can correspond to all or a portion of a FOS-related protein, preferably including at least one biologically active portion of a FOS-related protein. Within the fusion protein, the term "operably linked" is intended to indicate that the FOS-related polypeptide and the non-FOS-related polypeptide are fused in-frame to each other. The non-FOS-related polypeptide can be fused to the N-terminus or C-terminus of the FOS-related polypeptide.

Expression of the linked coding sequences results in two linked heterologous amino acid sequences which form the fusion protein. The carrier sequence (the non-FOS-related polypeptide) encodes a carrier polypeptide that potentiates or increases expression of the fusion protein in the bacterial host. The portion of the fusion protein encoded by the carrier sequence, i.e., the carrier polypeptide, may be a protein fragment, an entire functional moiety, or an entire protein sequence. The carrier region or polypeptide may additionally be designed to be used in purifying the fusion protein, either with antibodies or with affinity purification specific for that carrier polypeptide. Likewise, physical properties of the carrier polypeptide can be exploited to allow selective purification of the fusion protein.

Particular carrier polypeptides of interest include superoxide dismutase (SOD), maltose-binding protein (MBP), glutathione-S-transferase (GST), an N-terminal histidine (His) tag, and the like. This list is not intended to be limiting, as any carrier polypeptide that potentiates expression of the FOS-related protein as a fusion protein can be used in the methods of the invention.

In one embodiment, the fusion protein is a GST-FOS-related fusion protein in which the FOS-related sequences are fused to the C-terminus of the GST sequences. In another embodiment, the fusion protein is a FOS-related-immunoglobulin fusion protein in which all or part of a FOS-related protein is fused to sequences derived from a member of the immunoglobulin protein family. The FOS-related-immunoglobulin fusion proteins of the invention can be used as immunogens to produce anti-FOS-related antibodies in a subject, to purify FOS-related ligands, and in screening assays to identify molecules that inhibit the interaction of a FOS-related protein with a FOS-related ligand.

In one embodiment of the invention, the fusion protein has the ability to modify the functional properties of a bacterial cell. By "functional properties" is intended the ability of a bacterium ability to perform certain non-native functions, such as those related to adhesion, immune stimulation, or lysis. The non-FOS-related protein may include, but is not limited to, an antibody, an enzyme, a vaccine antigen, a protein with bactericidal activity, or a protein with receptor-binding activity. By "bactericidal activity" is intended the ability to kill one or more bacteria. By "receptor-binding activity" is intended the ability to bind to a receptor on a cell membrane, cell surface, or in solution. Methods to assess the ability of a fusion protein expressed on the surface of gram-positive bacteria to be used as a vaccine are known in the art (see, for example, Fischetti et al. (1996) *Curr. Opin. Biotechnol.* 7:659-666; Pouwels et al. (1998) *Int. J. Food Microbiol.* 41:155-167).

One of skill in the art will recognize that the particular carrier polypeptide is chosen with the purification scheme in mind. For example, His tags, GST, and maltose-binding protein represent carrier polypeptides that have readily available affinity columns to which they can be bound and eluted. Thus, where the carrier polypeptide is an N-terminal His tag such as hexahistidine ($His_6$ tag), the FOS-related fusion protein can be purified using a matrix comprising a metal-chelating resin, for example, nickel nitrilotriacetic acid (Ni-NTA), nickel iminodiacetic acid (Ni-IDA), and cobalt-containing resin (Co-resin). See, for example, Steinert et al. (1997) *QIAGEN News* 4:11-15, herein incorporated by reference in its entirety. Where the carrier polypeptide is GST, the FOS-related fusion protein can be purified using a matrix comprising glutathione-agarose beads (Sigma or Pharmacia Biotech); where the carrier polypeptide is a maltose-binding protein (MBP), the FOS-related fusion protein can be purified using a matrix comprising an agarose resin derivatized with amylose.

Preferably, a chimeric or fusion protein of the invention is produced by standard recombinant DNA techniques. For example, DNA fragments coding for the different polypeptide sequences may be ligated together in-frame, or the fusion gene can be synthesized, such as with automated DNA synthesizers. Alternatively, PCR amplification of gene fragments can be carried out using anchor primers that give rise to complementary overhangs between two consecutive gene fragments, which can subsequently be annealed and re-amplified to generate a chimeric gene sequence (see, e.g., Ausubel et al., eds. (1995) *Current Protocols in Molecular Biology*) (Greene Publishing and Wiley-Interscience, NY). Moreover, a FOS-related-protein-encoding nucleic acid can be cloned into a commercially available expression vector such that it is linked in-frame to an existing fusion moiety.

The fusion protein expression vector is typically designed for ease of removing the carrier polypeptide to allow the FOS-related protein to retain the native biological activity associated with it. Methods for cleavage of fusion proteins are known in the art. See, for example, Ausubel et al., eds. (1998) *Current Protocols in Molecular Biology* (John Wiley & Sons, Inc.). Chemical cleavage of the fusion protein can be accomplished with reagents such as cyanogen bromide, 2-(2-nitrophenylsulphenyl)-3-methyl-3'-bromoindolenine, hydroxylamine, or low pH. Chemical cleavage is often accomplished under denaturing conditions to cleave otherwise insoluble fusion proteins.

Where separation of the FOS-related polypeptide from the carrier polypeptide is desired and a cleavage site at the junction between these fused polypeptides is not naturally occurring, the fusion construct can be designed to contain a specific protease cleavage site to facilitate enzymatic cleavage and removal of the carrier polypeptide. In this manner, a linker sequence comprising a coding sequence for a peptide that has a cleavage site specific for an enzyme of interest can be fused in-frame between the coding sequence for the carrier polypeptide (for example, MBP, GST, SOD, or an N-terminal His tag) and the coding sequence for the FOS-related polypeptide. Suitable enzymes having specificity for cleavage sites include, but are not limited to, factor Xa, thrombin, enterokinase, remin, collagenase, and tobacco etch virus (TEV) protease. Cleavage sites for these enzymes are well known in the art. Thus, for example, where factor Xa is to be used to cleave the carrier polypeptide from the FOS-related polypeptide, the fusion construct can be designed to comprise a linker sequence encoding a factor Xa-sensitive cleavage site, for example, the sequence IEGR (see, for example, Nagai and Thøgersen (1984) *Nature* 309:810-812, Nagai and Thøgersen (1987) *Meth. Enzymol.* 153:461-481, and Pryor and Leiting (1997) *Protein Expr. Purif.* 10(3):309-319, herein incorporated by reference). Where thrombin is to be used to cleave the carrier polypeptide from the FOS-related polypeptide, the fusion construct can be designed to comprise a linker sequence encoding a thrombin-sensitive cleavage site, for example the sequence LVPRGS or VIAGR (see, for example, Pryor and Leiting (1997) *Protein Expr. Purif.* 10(3):309-319, and Hong et al. (1997) *Chin. Med. Sci. J.* 12(3):143-147, respectively, herein incorporated by reference). Cleavage sites for TEV protease are known in the art. See, for example, the cleavage sites described in U.S. Pat. No. 5,532,142, herein incorporated by reference in its entirety. See also the discussion in Ausubel et al., eds. (1998) *Current Protocols in Molecular Biology* (John Wiley & Sons, Inc.), Chapter 16.

Antibodies

An isolated polypeptide of the present invention can be used as an immunogen to generate antibodies that specifically bind FOS-related proteins, or stimulate production of antibodies in vivo. The full-length FOS-related protein can be used as an immunogen or, alternatively, antigenic peptide fragments of FOS-related proteins as described herein can be used. The antigenic peptide of an FOS-related protein comprises at least 8, preferably 10, 15, 20, or 30 amino acid residues of the amino acid sequence shown in even SEQ ID NOS:1-172 and encompasses an epitope of an FOS-related protein such that an antibody raised against the peptide forms a specific immune complex with the FOS-related protein. Preferred epitopes encompassed by the antigenic peptide are regions of a FOS-related protein that are located on the surface of the protein, e.g., hydrophilic regions.

Recombinant Expression Vectors

The nucleic acid molecules of the present invention may be included in vectors, preferably expression vectors. "Vector" refers to a nucleic acid molecule capable of transporting another nucleic acid to which it has been linked. Expression vectors include one or more regulatory sequences and direct the expression of genes to which they are operably linked. By "operably linked" is intended that the nucleotide sequence of interest is linked to the regulatory sequence(s) such that expression of the nucleotide sequence is allowed (e.g., in an in vitro transcription/translation system or in a host cell when the vector is introduced into the host cell). The term "regulatory sequence" or "regulatory element" is intended to include controllable transcriptional promoters, operators, enhancers, transcriptional terminators, and other expression control elements such as translational control sequences (e.g., Shine-Dalgarno consensus sequence, initiation and termination codons). These regulatory sequences will differ, for example, depending on the host cell being used.

The vectors can be autonomously replicated in a host cell (episomal vectors), or may be integrated into the genome of a host cell, and replicated along with the host genome (non-episomal mammalian vectors). Integrating vectors typically contain at least one sequence homologous to the bacterial chromosome that allows for recombination to occur between homologous DNA in the vector and the bacterial chromosome. Integrating vectors may also comprise bacteriophage or transposon sequences. Episomal vectors, or plasmids are circular double-stranded DNA loops into which additional DNA segments can be ligated. Plasmids capable of stable maintenance in a host are generally the preferred form of expression vectors when using recombinant DNA techniques.

The expression constructs or vectors encompassed in the present invention comprise a nucleic acid construct of the invention in a form suitable for expression of the nucleic acid in a host cell. In addition, it includes nucleic acid sequences encoding the regulatory region of the FOS operon, which can be used as a promoter element in expression vectors. Expression in prokaryotic host cells is encompassed in the present invention. It will be appreciated by those skilled in the art that the design of the expression vector can depend on such factors as the choice of the host cell to be transformed, the level of expression of protein desired, etc. The expression vectors of the invention can be introduced into host cells to thereby produce proteins or peptides, including fusion proteins or peptides, encoded by nucleic acids as described herein (e.g., FOS-related proteins, mutant forms of FOS-related proteins, fusion proteins, etc.).

Regulatory sequences include those that direct constitutive expression of a nucleotide sequence as well as those that direct inducible expression of the nucleotide sequence only under certain environmental conditions. A bacterial promoter is any DNA sequence capable of binding bacterial RNA polymerase and initiating the downstream (3') transcription of a coding sequence (e.g., structural gene) into mRNA. A promoter will have a transcription initiation region, which is usually placed proximal to the 5' end of the coding sequence. This transcription initiation region typically includes an RNA polymerase binding site and a transcription initiation site. A bacterial promoter may also have a second domain called an operator, which may overlap an adjacent RNA polymerase binding site at which RNA synthesis begins. The operator permits negative regulated (inducible) transcription, as a gene repressor protein may bind the operator and thereby inhibit transcription of a specific gene. Constitutive expression may occur in the absence of negative regulatory elements, such as the operator. In addition, positive regulation may be achieved by a gene activator protein binding sequence, which, if present is usually proximal (5') to the RNA polymerase binding sequence.

An example of a gene activator protein is the catabolite activator protein (CAP), which helps initiate transcription of the lac operon in *Escherichia coli* (Raibaud et al. (1984) *Annu. Rev. Genet.* 18:173). Regulated expression may therefore be either positive or negative, thereby either enhancing or reducing transcription. Other examples of positive and negative regulatory elements are well known in the art. Various promoters that can be included in the protein expression system include, but are not limited to, a T7/LacO hybrid promoter, a trp promoter, a T7 promoter, a lac promoter, and a bacteriophage lambda promoter. Any suitable promoter can be used to carry out the present invention, including the native promoter or a heterologous promoter. Heterologous promoters may be constitutively active or inducible. A non-limiting example of a heterologous promoter is given in U.S. Pat. No. 6,242,194 to Kullen and Klaenhammer.

Sequences encoding metabolic pathway enzymes provide particularly useful promoter sequences. Examples include promoter sequences derived from sugar metabolizing enzymes, such as galactose, lactose (lac) (Chang et al. (1987) *Nature* 198:1056), and maltose. Additional examples include promoter sequences derived from biosynthetic enzymes such as tryptophan (trp) (Goeddel et al. (1980) *Nucleic Acids Res.* 8:4057; Yelverton et al. (1981) *Nucleic Acids Res.* 9:731; U.S. Pat. No. 4,738,921; EPO Publication Nos. 36,776 and 121,775). The beta-lactamase (bla) promoter system (Weissmann, (1981) "The Cloning of Interferon and Other Mistakes," in *Interferon* 3 (ed. I. Gresser); bacteriophage lambda PL (Shimatake et al. (1981) *Nature* 292:128); the arabinose-inducible araB promoter (U.S. Pat. No. 5,028,530); and T5 (U.S. Pat. No. 4,689,406) promoter systems also provide useful promoter sequences. See also Balbas (2001) *Mol. Biotech.* 19:251-267, where *E. coli* expression systems are discussed.

In addition, synthetic promoters that do not occur in nature also function as bacterial promoters. For example, transcription activation sequences of one bacterial or bacteriophage promoter may be joined with the operon sequences of another bacterial or bacteriophage promoter, creating a synthetic hybrid promoter (U.S. Pat. No. 4,551,433). For example, the tac (Amann et al. (1983) *Gene* 25:167; deBoer et al. (1983) *Proc. Natl. Acad. Sci.* 80:21) and trc (Brosius et al. (1985) *J. Biol. Chem.* 260:3539-3541) promoters are hybrid trp-lac promoters comprised of both trp promoter and lac operon sequences that are regulated by the lac repressor. The tac promoter has the additional feature of being an inducible regulatory sequence. Thus, for example, expression of a coding sequence operably linked to the tac promoter can be induced in a cell culture by adding isopropyl-1-thio-β-D-galactoside (IPTG). Furthermore, a bacterial promoter can include naturally occurring promoters of non-bacterial origin that have the ability to bind bacterial RNA polymerase and initiate transcription. A naturally occurring promoter of non-bacterial origin can also be coupled with a compatible RNA polymerase to produce high levels of expression of some genes in prokaryotes. The bacteriophage T7 RNA polymerase/promoter system is an example of a coupled promoter system (Studier et al. (1986) *J. Mol. Biol.* 189:113; Tabor et al. (1985) *Proc. Natl. Acad. Sci.* 82: 1074). In addition, a hybrid promoter can also be comprised of a bacteriophage promoter and an *E. coli* operator region (EPO Publication No. 267, 851).

The vector may additionally contain a gene encoding the repressor (or inducer) for that promoter. For example, an inducible vector of the present invention may regulate transcription from the Lac operator (LacO) by expressing the gene encoding the LacI repressor protein. Other examples include the use of the lexA gene to regulate expression of pRecA, and the use of trpO to regulate ptrp. Alleles of such genes that increase the extent of repression (e.g., lacIq) or that modify the manner of induction (e.g., .lambda.CI857, rendering .lambda.pL thermo-inducible, or .lambda.CI+, rendering .lambda.pL chemo-inducible) may be employed.

In addition to a functioning promoter sequence, an efficient ribosome-binding site is also useful for the expression of the fusion construct. In prokaryotes, the ribosome binding site is called the Shine-Dalgarno (SD) sequence and includes an initiation codon (ATG) and a sequence 3-9 nucleotides in length located 3-11 nucleotides upstream of the initiation codon (Shine et al. (1975) *Nature* 254:34). The SD sequence is thought to promote binding of mRNA to the ribosome by the pairing of bases between the SD sequence and the 3' end of bacterial 16S rRNA (Steitz et al. (1979) "Genetic Signals and Nucleotide Sequences in Messenger RNA," in *Biological Regulation and Development: Gene Expression* (ed. R. F. Goldberger, Plenum Press, NY).

FOS-related proteins can also be secreted from the cell by creating chimeric DNA molecules that encode a protein comprising a signal peptide sequence fragment that provides for secretion of the FOS-related polypeptides in bacteria (U.S. Pat. No. 4,336,336). The signal sequence fragment typically encodes a signal peptide comprised of hydrophobic amino acids that direct the secretion of the protein from the cell. The protein is either secreted into the growth media (Gram-positive bacteria) or into the periplasmic space, located between the inner and outer membrane of the cell (gram-negative bacteria). Preferably there are processing sites, which can be cleaved either in vivo or in vitro, encoded between the signal peptide fragment and the FOS-related protein.

DNA encoding suitable signal sequences can be derived from genes for secreted bacterial proteins, such as the *E. coli* outer membrane protein gene (ompA) (Masui et al. (1983) *FEBS Lett.* 151(1):159-164; Ghrayeb et al. (1984) *EMBO J.* 3:2437-2442) and the *E. coli* alkaline phosphatase signal sequence (phoA) (Oka et al. (1985) *Proc. Natl. Acad. Sci.* 82:7212). Other prokaryotic signals include, for example, the signal sequence from penicillinase, Ipp, or heat stable enterotoxin II leaders.

Bacteria such as *L. acidophilus* generally utilize the start codon ATG, which specifies the amino acid methionine (which is modified to N-formylmethionine in prokaryotic organisms). Bacteria also recognize alternative start codons, such as the codons GTG and TTG, which code for valine and leucine, respectively. When they are used as the initiation codon, however, these codons direct the incorporation of methionine rather than of the amino acid they normally encode. *Lactobacillus acidophilus* NCFM recognizes these alternative start sites and incorporates methionine as the first amino acid.

Typically, transcription termination sequences recognized by bacteria are regulatory regions located 3' to the translation stop codon and thus, together with the promoter, flank the coding sequence. These sequences direct the transcription of an mRNA that can be translated into the polypeptide encoded by the DNA. Transcription termination sequences frequently include DNA sequences (of about 50 nucleotides) that are capable of forming stem loop structures that aid in terminating transcription. Examples include transcription termination sequences derived from genes with strong promoters, such as the trp gene in *E. coli* as well as other biosynthetic genes.

The expression vectors will have a plurality of restriction sites for insertion of the FOS-related sequence so that it is under transcriptional regulation of the regulatory regions. Selectable marker genes that ensure maintenance of the vector in the cell can also be included in the expression vector. Preferred selectable markers include those which confer resistance to drugs such as ampicillin, chloramphenicol, erythromycin, kanamycin (neomycin), and tetracycline (Davies et al. (1978) *Annu. Rev. Microbiol.* 32:469). Selectable markers may also allow a cell to grow on minimal medium, or in the presence of toxic metabolite and may include biosynthetic genes, such as those in the histidine, tryptophan, and leucine biosynthetic pathways.

The regulatory regions may be native (homologous), or may be foreign (heterologous) to the host cell and/or the nucleotide sequence of the invention. The regulatory regions may also be natural or synthetic. Where the region is "foreign" or "heterologous" to the host cell, it is intended that the region is not found in the native cell into which the region is introduced. Where the region is "foreign" or "heterologous" to the FOS-related nucleotide sequence of the invention, it is intended that the region is not the native or naturally occurring region for the operably linked FOS-related nucleotide sequence of the invention. For example, the region may be derived from phage. While it may be preferable to express the sequences using heterologous regulatory regions, native regions may be used. Such constructs would be expected in some cases to alter expression levels of FOS-related proteins in the host cell. Thus, the phenotype of the host cell could be altered.

In preparing the expression cassette, the various DNA fragments may be manipulated, so as to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites, or the like. For this purpose, in vitro mutagenesis, primer repair, restriction, annealing, resubstitutions, e.g., transitions and transversions, may be involved.

The invention further provides a recombinant expression vector comprising a DNA molecule of the invention cloned into the expression vector in an antisense orientation. That is, the DNA molecule is operably linked to a regulatory sequence in a manner that allows for expression (by transcription of the DNA molecule) of an RNA molecule that is antisense to FOS-related mRNA. Regulatory sequences operably linked to a nucleic acid cloned in the antisense orientation can be chosen to direct the continuous or inducible expression of the antisense RNA molecule. The antisense expression vector can be in the form of a recombinant plasmid or phagemid in which antisense nucleic acids are produced under the control of a high efficiency regulatory region, the activity of which can be determined by the cell type into which the vector is introduced. For a discussion of the regulation of gene expression using antisense genes see Weintraub et al. (1986) *Reviews—Trends in Genetics*, Vol. 1(1).

Alternatively, some of the above-described components can be put together in transformation vectors. Transformation vectors are typically comprised of a selectable market that is either maintained in a replicon or developed into an integrating vector, as described above.

Microbial or Bacterial Host Cells

The production of bacteria containing the nucleic acid sequences or proteins designated, the preparation of starter cultures of such bacteria, and methods of fermenting substrates, particularly food substrates such as milk, may be carried out in accordance with known techniques. (See, for example, Gilliland, S. E. (ed) Bacterial Starter Cultures for Food, CRC press, 1985, 205 pp.; Read, G. (Ed.). Prescott and Dunn's Industrial Microbiology, $4^{th}$ Ed. AVI Publishing Company, Inc. 1982, 883 pp.; Peppler, J. J. and Perlman, D. (Eds.). Microbial Technology: Volume II, Fermentation Technology. Academic Press, 1979, 536 pp.)

By "fermenting" is intended the energy-yielding, metabolic breakdown of organic compounds by microorganisms that generally proceed under anaerobic conditions and with the evolution of gas.

By "introducing" as it pertains to nucleic acid molecules is intended introduction into prokaryotic cells via conventional transformation or transfection techniques, or by phage-mediated infection. As used herein, the terms "transformation," "transduction," "conjugation," and "protoplast fusion" are intended to refer to a variety of art-recognized techniques for introducing foreign nucleic acid (e.g., DNA) into a host cell, including calcium phosphate or calcium chloride co-precipitation, DEAE-dextran-mediated transfection, lipofection, or electroporation. Suitable methods for transforming or transfecting host cells can be found in Sambrook et al. (1989) *Molecular Cloning: A Laboratory Manual* (2d ed., Cold Spring Harbor Laboratory Press, Plainview, N.Y.) and other laboratory manuals. By "introducing" as it pertains to polypeptides or microorganisms of the invention, is intended introduction into a host by ingestion, topical application, nasal, urogenital, suppository, or oral application of the polypeptide or microorganism.

Bacterial cells used to produce the FOS-related polypeptides of this invention are cultured in suitable media, as described generally in Sambrook et al. (1989) *Molecular Cloning, A Laboratory Manual* (2d ed., Cold Spring Harbor Laboratory Press, Plainview, N.Y.).

Function and Assays

Bacterial high affinity transport systems are involved in active transport of solutes across the cytoplasmic membrane. The protein components of these traffic systems include one or two transmembrane protein components, one or two membrane-associated ATP-binding proteins and a high affinity periplasmic solute-binding protein. In Gram-positive bacteria, which are surrounded by a single membrane and therefore have no periplasmic region, the equivalent proteins are bound to the membrane via an N-terminal lipid anchor. These homologue proteins do not play an integral role in the transport process per se, but probably serve as receptors to trigger or initiate translocation of the solute through the membrane by binding to external sites of the integral membrane proteins of the efflux system. In addition at least some solute-binding proteins function in the initiation of sensory transduction pathways.

On the basis of sequence similarities, the vast majority of these solute-binding proteins can be grouped into eight families of clusters, which generally correlate with the nature of the solute bound (Tam and Saier (1993) *Microbiol. Rev.* 57:320-346). Family 1 (PFAM Accession No. PF01547) currently includes the periplasmic proteins maltose/maltodextrin-binding proteins of Enterobacteriaceae (gene malE) (Sharff et al. (1995) *J. Mol. Biol.* 246:8-13) and *Streptococcus pneumoniae* malX; multiple oligosaccharide binding protein of *Streptococcus mutans* (gene msmE); *Escherichia coli* glycerol-3-phosphate-binding protein; *Serratia marcescens* iron-binding protein (gene sfuA) and the homologous proteins (gene fbp) from *Haemophilus influenzae* and *Neisseria*; and *Escherichia coli* thiamine-binding protein (gene tbpA). Solute-binding proteins in family 1 of the present invention include those in SEQ ID NOS:2, 60.

Bacterial binding protein-dependent transport systems are multicomponent systems typically composed of a periplasmic substrate-binding protein, one or two reciprocally homologous integral inner-membrane proteins and one or two peripheral membrane ATP-binding proteins that couple energy to the active transport system (Ames (1986) *Annu. Rev. Biochem.* 55:397-425; Higgins et al. (1990) *J. Bioenerg. Biomembr.* 22:571-592). The integral inner-membrane proteins (PFAM Accession No. PF00528) translocate the substrate across the membrane. It has been shown that most of these proteins contain a conserved region located about 80 to 100 residues from their C-terminal extremity (Dassa and Hofnung (1985) *EMBO J.* 4:2287-2293; Saurin et al. (1994) *Mol. Microbiol.* 12:993-1004). This region seems to be located in a cytoplasmic loop between two transmembrane domains (Pearce et al. (1992) *Mol. Microbiol.* 6:47-57). Apart from the conserved region, the sequence of these proteins is quite divergent, and they have a variable number of transmembrane helices, however they can be classified into seven families which have been respectively termed: araH, cysTW, fecCD, hisMQ, livHM, malFG and oppBC. Inner membrane proteins of the present invention include those in SEQ ID NOS:4, 6.

Assays to measure transport activity are well known in the art (see, for example, Hung et al. (1998) *Nature* 396:703-707; Higgins et al. (1990) *J. Bioenerg. Biomembr.* 22:571-592).

Glycosyl hydrolases, such as the O-Glycosyl hydrolases (EC 3.2.1.-) are a widespread group of enzymes that hydrolyse the glycosidic bond between two or more carbohydrates, or between a carbohydrate and a non-carbohydrate moiety. Glycosyl hydrolase family 32 (PFAM Accession PF00251) comprises enzymes with several known activities; invertase (EC:3.2.1.26); inulinase (EC:3.2.1.7); levanase (EC:3.2.1.65); exo-inulinase (EC:3.2.1.80); sucrose:sucrose 1-fructosyltransferase (EC:2.4.1.99); and fructan:fructan 1-fructosyltransferase (EC:2.4.1.100). Glycosyl hydrolase family 32 proteins of the present invention include that in SEQ ID NO:8.

Assays to measure hydrolase activity are well known in the art (see, for example, Avigad and Bauer (1966) *Methods Enzymol.* 8:621-628; Neumann and Lampen (1967) *Biochemistry* 6:468-475; Henry and Darbyshire (1980) *Phytochemistry* 19:1017-1020).

ABC transporters (PFAM Accession PF00005) form a large family of proteins responsible for translocation of a variety of compounds across biological membranes. They are minimally composed of four domains, with two transmembrane domains (TMDs) responsible for allocrite binding and transport and two nucleotide-binding domains (NBDs) responsible for coupling the energy of ATP hydrolysis to conformational changes in the TMDs. Both NBDs are capable of ATP hydrolysis, and inhibition of hydrolysis at one NBD effectively abrogates hydrolysis at the other. The proteins belonging to this family also contain one or two copies of the 'A' consensus sequence (Walker et al. (1982) *EMBO J.* 1:945-951) or the 'P-loop' (Saraste et al. (1990) *Trends Biochem Sci.* 15:430-434). Methods for measuring ATP-binding and transport are well known in the art (see, for example, Hung et al. (1998) *Nature* 396:703-707; Higgins et al. (1990) *J. Bioenerg. Biomembr.* 22:571-592). ABC transporters proteins of the present invention include those in SEQ ID NOS: 10.

Phosphoribosylglycinamide synthetase (GARS) (EC: 6.3.4.13) (phosphoribosylamineglycine ligase) catalyses the second step in the de novo biosynthesis of purine (Aiba and Mizobuchi (1989) *J. Biol. Chem.* 264:21239-21246). The reaction catalysed by phosphoribosylglycinamide synthetase is the ATP-dependent addition of 5-phosphoribosylamine to glycine to form 5' phosphoribosylglycinamide. The ATP-grasp (A) domain (PFAM Accession No. PF01071) is related to the ATP-grasp domain of biotin carboxylase/carbamoyl phosphate synthetase. The B domain family (PFAM Accession No. PF02842) is related to biotin carboxylase/carbamoyl phosphate synthetase. The C domain family (PFAM Accession No. PF02843) is related to the C-terminal domain of biotin carboxylase/carbamoyl phosphate synthetase. The N domain family (PFAM Accession No. PF02844) is related to the N-terminal domain of biotin carboxylase/carbamoyl phosphate synthetase.

In bacteria GARS is a monofunctional enzyme (encoded by the purD gene); in yeast it is part, with phosphoribosylformylglycinamidine cyclo-ligase (AIRS) of a bifunctional enzyme (encoded by the ADE5,7 gene); and in higher eukaryotes it is part, with AIRS and with phosphoribosylglycinamide formyltransferase (GART) of a trifunctional enzyme (GARS-AIRS-GART). Assays to measure phosphoribosylamineglycine ligase activity are well known in the art (see, for example, Aiba and Mizobuchi (1989) *J. Biol. Chem.* 264: 21239-21246). Phosphoribosylglycinamide synthetase proteins of the present invention include those in SEQ ID NOS: 14.

Methylglyoxal synthase (EC:4.2.3.3) (MGS) (PFAM Accession No. PF02142) catalyzes the conversion of dihydroxyacetone phosphate to methylglyoxal and phosphate (Saadat and Harrison (1999) *Structure Fold Des.* 7:309-317). It provides bacteria with an alternative to triosephosphate isomerase for metabolizing dihydroxyacetone phosphate. Methylglyoxal synthase contains a domain shared by other enzymes. Other proteins containing this domain include purine biosynthesis protein PurH and carbamoyl phosphate synthetase. Methods to assay for catalytic activity are well known in the art (see, for example, Ray and Ray (1981) *J. Biol. Chem.* 256:6230-6233). Methylglyoxal synthase-like proteins of the current invention include those in SEQ ID NOS:16.

The AICARFT/IMPCHase bienzyme family (PFAM Accession No. PF01808) is a family of bifunctional enzymes catalysing the last two steps in de novo purine biosynthesis. The bifunctional enzyme is found in both prokaryotes and eukaryotes. The second-to-last step is catalysed by 5-aminoimidazole-4-carboxamide ribonucleotide formyltransferase (EC:2.1.2.3) (AICARFT). This enzyme catalyses the formylation of AICAR with 10-formyl-tetrahydrofolate to yield FAICAR and tetrahydrofolate (Akira et al. (1997) *Gene* 197:289-293). The last step is catalysed by IMP (Inosine monophosphate) cyclohydrolase (EC:3.5.4.10) (IMPCHase), cyclizing FAICAR (5-formylaminoimidazole-4-carboxamide ribonucleotide) to IMP (Akira et al., supra). Methods to assay for phosphoribosylaminoimidazolecarboxamide formyltransferase activity are well known in the art (see, for example, Rayl et al. (1996) *J. Biol. Chem.* 271:2225-2233). Phosphoribosylaminoimidazolecarboxamide formyltransferase proteins of the current invention include those in SEQ ID NOS:16.

Formyl transferases (PFAM Accession No. PF00551) include glycinamide ribonucleotide transformylase, which catalyses the third step in de novo purine biosynthesis, the transfer of a formyl group to 5'-phosphoribosylglycinamide; formyltetrahydrofolate deformylase, which produces formate from formyl-tetrahydrofolate; and methionyl-tRNA formyltransferase, which transfers a formyl group onto the amino terminus of the acyl moiety of the methionyl aminoacyl-tRNA. The formyl group appears to play a dual role in the initiator identity of N-formylmethionyl-tRNA by promoting its recognition by IF2 and by impairing its binding to EFTU-GTP. Also included are formyltetrahydrofolate dehydrogenase, which produces formate from formyl-tetrahydrofolate. This family encompasses the N-terminal domain of these enzymes and is found upstream of the C-terminal domain. Methods to assay for transferase activity are well known in the art (see, for example, Lee et al. (2003) *Protein Sci.* 12:2206-2214). Formyl transferases of the present invention include those in SEQ ID NOS:18.

Members of the AIR synthase related protein family, including the N-terminal domain family (PFAM Accession No. PF00586) and the C-terminal domain family (PFAM Accession No. PF02769) include the hydrogen expression/formation protein HypE, which may be involved in the maturation of NifE hydrogenase; AIR synthases (EC:6.3.3.1) and FGAM synthase (EC:6.3.5.3) (PFAM Accession No. PF02700), which are involved in de novo purine biosynthesis; and selenide, water dikinase (EC:2.7.9.3), an enzyme which synthesizes selenophosphate from selenide and ATP. The N-terminal domain of AIR synthase forms the dimer interface of the protein, and is suggested as a putative ATP binding domain (Li et al. (1999) *Structure Fold Des.* 7:1155-1166). Methods to assay for synthase activity are well known in the art (see, for example, Saxild and Nygaard (2000) *Microbiology* 146:807-814; Peltonen and Mantsala (1999) *Mol. Gen. Genet.* 261:31-41). AIR synthase-related proteins of the present invention include those found in SEQ ID NOS:20, 24, 26, 28.

A large group of biosynthetic enzymes are able to catalyse the removal of the ammonia group from glutamine and the transfer of this group to a substrate to form a new carbon-nitrogen group. This catalytic activity is known as glutamine amidotransferase (GATase) (EC:2.4.2) (Buchanan (1973) *Adv. Enzymol. Relat. Areas Mol. Biol.* 39:91-183). The GATase domain exists either as a separate polypeptidic subunit or as part of a larger polypeptide fused in different ways to a synthase domain. On the basis of sequence similarities two classes of GATase domains have been identified (Weng and Zalkin (1987) *J. Bacteriol.* 169:3023-3028; Nyunoya and Lusty (1984) *J. Biol. Chem.* 259:9790-9798), class-I (also known as trpG-type) (PFAM Accession No. PF00310) and class-II (also known as purF-type) (PFAM Accession No. PF00310). Enzymes containing Class-II GATase domains include amido phosphoribosyltransferase (glutamine phosphoribosylpyrophosphate amidotransferase) (EC:2.4.2.14), which catalyses the first step in purine biosynthesis (gene purF in bacteria, ADE4 in yeast); glucosamine-fructose-6-phosphate aminotransferase (EC:2.6.1.16), which catalyses the formation of glucosamine 6-phosphate from fructose 6-phosphate and glutamine (gene glmS in *Escherichia coli*, nodM in *Rhizobium*, GFA1 in yeast); and asparagine synthetase (glutamine-hydrolizing) (EC:6.3.5.4), which is responsible for the synthesis of asparagine from aspartate and glutamine. A cysteine is present at the N-terminal extremity of the mature form of all these enzymes. Assays to measure transferase activity are well known in the art (see, for example, Bera et al. (2000) *J. Bacteriol.* 182:3734-3739). Phosphoribosylpyrophosphate amidotransferases of the present invention include those in SEQ ID NOS:22.

Members of the phosphoribosyltransferase (PRT) family (PFAM Accession No. PF00156) are catalytic and regulatory proteins involved in nucleotide synthesis and salvage. Phosphoribosyltransferase enzymes carry out phosphoryl transfer reactions on PRPP, an activated form of ribose-5-phosphate. Not all PRT proteins are enzymes. For example, in some bacteria PRT proteins regulate the expression of purine and pyrimidine synthetic genes. Members of the family are defined by the protein fold and by a short sequence motif that was correctly predicted to be a PRPP-binding site. The PRT sequence motif is only found in PRTases from the nucleotide synthesis and salvage pathways. Other PRTases, from the tryptophan, histidine and nicotinamide synthetic and salvage pathways, lack the PRT sequence motif and are not members of this family. Assays to measure transferase activity are well known in the art (see, for example, Bera et al. (2000) *J. Bacteriol.* 182:3734-3739). Phosphoribosyltransferases of the present invention include those in SEQ ID NOS:22.

Phosphoribosylaminoimidazole-succinocarboxamide synthase (EC: 6.3.2.6) (SAICAR synthetase) (PFAM Accession No. PF01259) catalyzes the seventh step in the de novo purine biosynthetic pathway; the ATP-dependent conversion of 5'-phosphoribosyl-5-aminoimidazole-4-carboxylic acid and aspartic acid to SAICAR Zalkin and Dixon (1992) *Prog. Nucleic Acid Res. Mol. Biol.* 42:259-287). In bacteria (gene purC), fungi (gene ADE1) and plants, SAICAR synthetase is a monofunctional protein; in animals it is the N-terminal domain of a bifunctional enzyme that also catalyze phosphoribosylaminoimidazole carboxylase (AIRC) activity. Assays to measure phosphoribosylaminoimidazole-succinocarboxamide synthase activity are well known in the art (see, for example, Tyagi et al. (1980) *J. Biochem. Biophys. Methods* 2:123-132). Phosphoribosylaminoimidazole-succinocarboxamide synthases of the present invention include those in SEQ ID NOS:30.

The bacterial phosphoenolpyruvate: sugar phosphotransferase system (PTS) is a multi-protein system involved in the regulation of a variety of metabolic and transcriptional processes. The sugar-specific permease of the phosphoenolpyruvate-dependent sugarphosphotransferase system (PTS) consists of at least three structurally distinct domains (IIA, IIB, and IIC) which can either be fused together in a single polypeptide chain or exist as two or three interactive chains (Saier and Reizer (1992) *J. Bacteriol.* 174:1433-1438). The IIA domain (PFAM Accession No. PF00359) carries the first permease-specific phosphorylation site, a histidine which is phosphorylated by phospho-HPr. The second domain (IIB) (PFAM Accession No. PF00367) is phosphorylated by phospho-IIA on a cysteinyl or histidyl residue, depending on the permease. Finally, the phosphoryl group is transferred from the IIB domain to the sugar substrate in a process catalyzed by the IIC domain (PFAM Accession No. PF02378); this process is coupled to the transmembrane transport of the sugar. Phosphoenolpyruvate PTS proteins of the present invention include those in SEQ ID NOS:72

The PTS, a major carbohydrate transport system in bacteria, catalyzes the phosphorylation of incoming sugar substrates concomitant with their translocation across the cell membrane (Meadow et al. (1990) *Annu. Rev. Biochem.*

59:497-542; Postma et al. (1993) *Microbiol. Rev.* 57:543-594). The general mechanism of the PTS is the following: a phosphoryl group from phosphoenolpyruvate (PEP) is transferred to enzyme-I (EI) of PTS which in turn transfers it to a phosphoryl carrier protein (HPr). Phospho-HPr then transfers the phosphoryl group to the sugar-specific permease. Assays to measure activity of PTS system proteins are well known in the art. PTS system proteins of the present invention include those in SEQ ID NOS:32, 34, 50, 56, 58).

MIP (Major Intrinsic Protein) family proteins (PFAM Accession No. PF00230) exhibit essentially two distinct types of channel properties: (1) specific water transport by the aquaporins, and (2) small neutral solutes transport, such as glycerol by the glycerol facilitators (Froger et al. (1998) *Protein Sci.* 7: 1458-1468). The bacterial glycerol facilitator proteins (gene glpF), which facilitate the movement of glycerol across the cytoplasmic membrane, are members of this family. MIP family proteins are thought to contain 6 TM domains. Assays to measure transport activity are well known in the art (see, for example, Lu et al. (2003) *Biophys. J.* 85:2977-2987). MIP-like proteins of the present invention include those in SEQ ID NOS:36.

ABC transporters (PFAM Accession PF00005) form a large family of proteins responsible for translocation of a variety of compounds across biological membranes. They are minimally composed of four domains, with two transmembrane domains (TMDs) responsible for allocrite binding and transport and two nucleotide-binding domains (NBDs) responsible for coupling the energy of ATP hydrolysis to conformational changes in the TMDs. Both NBDs are capable of ATP hydrolysis, and inhibition of hydrolysis at one NBD effectively abrogates hydrolysis at the other. The proteins belonging to this family also contain one or two copies of the 'A' consensus sequence (Walker et al. (1982) *EMBO J.* 1:945-951) or the 'P-loop' (Saraste et al. (1990) *Trends Biochem Sci.* 15:430-434). Methods for measuring ATP-binding and transport are well known in the art (see, for example, Hung et al. (1998) *Nature* 396:703-707; Higgins et al. (1990) *J. Bioenerg. Biomembr.* 22:571-592). ABC transporters proteins of the present invention include those in SEQ ID NOS: 40, 42.

Bacterial binding protein-dependent transport systems are multicomponent systems typically composed of a periplasmic substrate-binding protein, one or two reciprocally homologous integral inner-membrane proteins (PFAM Accession No. PF00528) and one or two peripheral membrane ATP-binding proteins that couple energy to the active transport system (Ames (1986) *Annu. Rev. Biochem.* 55:397-425; Higgins et al. (1990) *J. Bioenerg. Biomembr.* 22:571-592). The integral inner-membrane proteins translocate the substrate across the membrane. It has been shown that most of these proteins contain a conserved region located about 80 to 100 residues from their C-terminal extremity (Dassa and Hofnung (1985) *EMBO J.* 4:2287-2293; Saurin et al. (1994) *Mol. Microbiol.* 2:993-1004). This region seems to be located in a cytoplasmic loop between two transmembrane domains (Pearce et al. (1992) *Mol. Microbiol.* 6:47-57). Methods for measuring transport are well known in the art (see, for example, Hung et al. (1998) *Nature* 396:703-707; Higgins et al. (1990) *J. Bioenerg. Biomembr.* 22:571-592). ABC transporters proteins of the present invention include those in SEQ ID NOS:44, 46.

Members of the permease family (PFAM Accession No. PF00860) have ten predicted transmembrane helices. Methods for measuring transport are well known in the art (see, for example, Hung et al. (1998) *Nature* 396:703-707; Higgins et al. (1990) *J. Bioenerg. Biomembr.* 22:571-592). Permease proteins of the present invention include those in SEQ ID NOS:48.

Many bacterial transcription regulation proteins which bind DNA through a 'helix-turn-helix' motif can be classified into subfamilies on the basis of sequence similarities. One such family (PFAM Accession No. PF00392) groups together a range of proteins, including gntR, hutC, korA, ntaR, and *Escherichia coli* proteins A, P30, fadR, exuR, farR, dgoR and phnF (Haydon and Guest (1991) *FEMS Microbiol. Lett.* 63:291-295; Buck and Guest (1989) *Biochem. J.* 260:737-747; Weizer et al. (1991) *Mol. Microbiol.* 5:1081-1089). Within this family, the HTH motif is situated towards the N-terminus. Assays to measure transcription factor activity are well known in the art (see, for example,). Transcription regulation proteins of the present invention include those in SEQ ID NOS:52.

Alpha amylase (PFAM Accession PF00128) is classified as family 13 of the glycosyl hydrolases. The structure of the alpha amylases consists of an 8 stranded alpha/beta barrel containing the active site, interrupted by an about 70 amino acid calcium-binding domain protruding between beta strand 3 and alpha helix 3, and a carboxyl-terminal Greek key beta-barrel domain. Assays to measure alpha-amylase activity are well known in the art (see, for example, Das et al. (2004) *Biotechnol. Appl. Biochem*. March 25; Grzybowska et al. (2004) *Mol. Biotechnol.* 26: 101-110). Alpha amylase proteins of the present invention include those in SEQ ID NOS: 54.

Ribosomes are the particles that catalyze mRNA-directed protein synthesis in all organisms. The codons of the mRNA are exposed on the ribosome to allow tRNA binding. This leads to the incorporation of amino acids into the growing polypeptide chain in accordance with the genetic information. Incoming amino acid monomers enter the ribosomal A site in the form of aminoacyl-tRNAs complexed with elongation factor Tu (EF-Tu) and GTP. The growing polypeptide chain, situated in the P site as peptidyl-tRNA, is then transferred to aminoacyl-tRNA and the new peptidyl-tRNA, extended by one residue, is translocated to the P site with the aid the elongation factor G (EF-G) and GTP as the deacylated tRNA is released from the ribosome through one or more exit sites (Ramakrishnan and Moore (2001) *Curr. Opin. Struct. Biol.* 11:144-154; Maguire and Zimmermann (2001) *Cell* 104:813-816). About ⅔ of the mass of the ribosome consists of RNA and ⅓ of protein. The proteins are named in accordance with the subunit of the ribosome which they belong to—the small (S1 to S31) and the large (L1 to L44). Usually they decorate the rRNA cores of the subunits. Ribosomal S and L-like proteins of the present invention include those in SEQ ID NOS:100, 108, 118, 122, 134, 150, 152, 158, 164, 166 and 168.

Many ribosomal proteins, particularly those of the large subunit, are composed of a globular, surfaced-exposed domain with long finger-like projections that extend into the rRNA core to stabilize its structure. Most of the proteins interact with multiple RNA elements, often from different domains. In the large subunit, about ⅓ of the 23S rRNA nucleotides are at least in van der Waal's contact with protein, and L22 interacts with all six domains of the 23S rRNA. Proteins S4 and S7, which initiate assembly of the 16S rRNA, are located at junctions of five and four RNA helices, respectively. In this way proteins serve to organize and stabilize the rRNA tertiary structure. While the crucial activities of decoding and peptide transfer are RNA based, proteins play an active role in functions that may have evolved to streamline the process of protein synthesis. In addition to their function in the ribosome, many ribosomal proteins have some function 'outside' the ribosome (Maguire and Zimmermann, supra; Chandra and Liljas (2000) *Curr. Opin. Struct. Biol.* 10:633-636). Ribosomal S4 and S7-like proteins of the present invention include those in SEQ ID NOS:116, 120

Ribosomal protein S12 (PFAM Accession No. PF00164) is one of the proteins from the small ribosomal subunit. In *Escherichia coli*, S12 is known to be involved in the translation initiation step. It is a very basic protein of 120 to 150 amino acid residues. S12 belongs to a family of ribosomal proteins which are grouped on the basis of sequence similarities. This protein is known typically as S12 in bacteria, S23 in eukaryotes and as either S12 or S23 in the Archaea. Ribosomal S12-like proteins of the present invention include those in SEQ ID NOS:62.

Enolase (2-phospho-D-glycerate hydrolase) is an essential glycolytic enzyme that catalyses the interconversion of 2-phosphoglycerate and phosphoenolpyruvate (Lal et al. (1991) *Plant Mol. Biol.* 16:787-795; Peshavaria and Day (1991) *Biochem. J.* 275:427-433). Assays to measure enolase activity are well known in the art (see, for example, Whiting et al. (2002) *J. Med. Microbiol.* 51:837-843). Enolase-like proteins of the present invention include those in SEQ ID NOS:66.

Elongation factors belong to a family of proteins that promote the GTP-dependent binding of aminoacyl-tRNA to the A site of ribosomes during protein biosynthesis, and catalyse the translocation of the synthesised protein chain from the A to the P site. The proteins are all relatively similar in the vicinity of their C-termini, and are also highly similar to a range of proteins that includes the nodulation Q protein from *Rhizobium meliloti*, bacterial tetracycline resistance proteins (LeBlanc et al. (1988) *J. Bacteriol.* 170:3618-3626) and the omnipotent suppressor protein 2 from yeast.

In both prokaryotes and eukaryotes, there are three distinct types of elongation factors, EF-1 alpha (EF-Tu), which binds GTP and an aminoacyl-tRNA and delivers the latter to the A site of ribosomes; EF-1beta (EF-Ts), which interacts with EF-1a/EF-Tu to displace GDP and thus allows the regeneration of GTP-EF-1a; and EF-2 (EF-G), which binds GTP and peptidyl-tRNA and translocates the latter from the A site to the P site. In EF-1-, a specific region has been shown (Moller et al. (1987) *Biochimie* 69:983-989) to be involved in a conformational change mediated by the hydrolysis of GTP to GDP. This region is conserved in both EF-1alpha/EF-Tu as well as EF-2/EF-G and thus seems typical for GTP-dependent proteins which bind non-initiator tRNAs to the ribosome.

Elongation factor Tu consists of three structural domains. The GTP-binding domain of EF-Tu proteins (PFAM Accession PF00009) contains a P-loop motif. The second domain (PFAM Accession PF03144) adopts a barrel structure, and is involved in binding to charged tRNA (Nissen et al., supra). This domain is also found in other proteins such as elongation factor G and translation initiation factor IF-2. The third domain (PFAM Accession PF03143) adopts a beta barrel structure and is involved in binding to both charged tRNA (Nissen et al. (1995) *Science* 270:1464-1472) and binding to EF-Ts (Wang et al. (1997) *Nat. Struct. Biol.* 4:650-656). Assays to measure elongation factor activity are well known in the art (see, for example, Hunter and Spremulli (2004) *Biochemisty* 43:6917-6927). Elongation factor Tu-like proteins of the present invention include those in SEQ ID NOS: 68.

Methods of Use

Methods are provided wherein properties of microbes used in fermentation are modified to provide strains able to metabolize FOS or complex carbohydrates and produce traditional or novel metabolic products which permit more efficient or more economic bioprocesses, or strains better able to survive, grow and colonize or inhabit the gastrointestinal tract of a host animal to which the strain is administered as a probiotic bacteria.

In one embodiment, expression or overexpression of a polynucleotide or polypeptide of the invention may modulate the growth rate of a bacterium. By "growth rate" is intended a measure of the rate of growth of an organism or culture. When the microorganism is grown in continuous liquid culture at an exponential growth rate, the increase in cell mass can be expressed in terms of the specific growth rate constant ($\mu$): $dP/dt=\mu \times P$, where P is the cell mass and t is the time. By "overexpressing" is intended that the protein of interest is produced in an increased amount in the modified bacterium compared to its production in a wild-type bacterium. Assays to measure the growth rate of bacteria are known in the art (see, for example, Bruinenberg et al. (1992) *Appl. Environ. Microbiol.* 58:78-84).

In a another embodiment, the polynucleotides or polypeptides of the present invention are useful in enhancing the ability of a bacterium to metabolize FOS and/or other complex carbohydrates (see Example 1, below). In another embodiment, the polynucleotides or polypeptides of the present invention are useful in modifying the ability of a bacterium to colonize the gastrointestinal tract of a host. In yet another embodiment, the polynucleotides or polypeptides of the present invention are useful for stimulating the growth of beneficial commensals in the gastrointestinal tract of a mammal.

TABLE 1

Most highly induced *Lactobacillus acidophilus* NCFM genes in the presence of fructooligosaccharides.

| ORF# | Gene | Function |
| --- | --- | --- |
| 502 | ABC substrate binding protein (msmE) (SEQ ID NO: 1) | Transport |
| 503 | ABC permease (SEQ ID NO: 3) (msmF) | Transport |
| 504 | ABC permease (SEQ ID NO: 5) (msmG) | Transport |
| 505 | Fructosidase (SEQ ID NO: 7) (brfA)(3.2.1.26) | Hydrolysis |
| 506 | ABC ATP binding protein (SEQ ID NO: 9) (msmK) | Transport |
| 507 | Sucrose phosphorylase (SEQ ID NO: 11) (gtfA)(2.4.1.7) | |

TABLE 1-continued

Most highly induced *Lactobacillus acidophilus* NCFM genes in the presence of fructooligosaccharides.

| ORF# | Gene | Function |
|---|---|---|
| 1551 | Phosphoribosylamine-glycine ligase (SEQ ID NO: 13) | Ligase |
| 1552 | Phosphoribosylaminoimidazolecarboxamide formylase (SEQ ID NO: 15) | Formylase |
| 1553 | Phosphoribosyl glycinamide transferase (SEQ ID NO: 17) | Transferase |
| 1554 | Phosphoribosylformylglycinamide cyclo-ligase (SEQ ID NO: 19) | Ligase |
| 1555 | Phosphoribosylpyrophosphate amidotransferase (SEQ ID NO: 21) | Transferase |
| 1556 | Phosphoribosylformylglycinamidine synthase purL (SEQ ID NO: 23) | Synthase |
| 1557 | Phosphoribosylformylglycinamidine synthase purQ (SEQ ID NO: 25) | Synthase |
| 1558 | Phosphoribosylformylglycinamidine (FGAM) synthase (SEQ ID NO: 27) | Synthase |
| 1559 | Phosphoribosylaminoimidazole-succinocarboxamide synthase (SEQ ID NO: 29) | Synthase |
| 401 | Sucrose PTS II ABC (scrA)(3.2.1.26) (SEQ ID NO: 31) | Transport/Phosphorylation |
| 402 | Sucrose PTS scrA (SEQ ID NO: 33) | Transport |
| 1595 | Glycerol uptake facilitator (SEQ ID NO: 35) | Transport |
| 367 | Putative receptor (SEQ ID NO: 37) | |
| 151 | Alkyl phosphonate ABC transporter (substrate binding) (SEQ ID NO: 39) | Akyl phosphonate Transport |
| 152 | Alkyl phosphonate ABC transporter ATP binding protein (SEQ ID NO: 41) | Transport |
| 153 | Alkyl phosphonate ABC transporter permease (SEQ ID NO: 43) | Transport |
| 154 | Alkyl phosphonate ABC transporter permease (SEQ ID NO: 45) | Transport |
| 1952 | (SEQ ID NO: 47) | Transport |
| 1012 | Trehalose PTS II ABC (2.7.1.69) (SEQ ID NO: 49) | Transport |
| 1013 | Trehalose operon transcriptional repressor (SEQ ID NO: 51) | Transcription repression |
| 1014 | Trehalose 6P hydrolase (treC)(3.2.1.93) (SEQ ID NO: 53) | Amylase |
| 455 | Mannose PTS (SEQ ID NO: 55) | Mannose transport |
| 456 | Mannose PTS (SEQ ID NO: 57) | Transport |
| 585 | Glycerol 3P ABC transporter (SEQ ID NO: 59) | Transport |
| 287 | 30S ribosomal protein (SEQ ID NO: 61) | |
| 169 | slpA (SEQ ID NO: 63) | |
| 889 | Phosphoglycerate dehydratase (SEQ ID NO: 65) | Enolase |
| 845 | Elongation factor Tu (3.6.1.48) (SEQ ID NO: 67) | Elongation |
| 957 | Pyruvate kinase (SEQ ID NO: 69) | |
| 1777 | Fructose PTS (SEQ ID NO: 71) | Transport |
| 1778 | Fructose 1P kinase (with PTS) (SEQ ID NO: 73) | |
| 271 | L-lactate dehydrogenase (SEQ ID NO: 75) | |
| 1559 | Fructose biP aldolase (SEQ ID NO: 77) | |
| 1779 | Fructose operon regulator (SEQ ID NO: 79) | |
| 360 | 50S protein (SEQ ID NO: 81) | |
| 55 | D-lactate dehydrogenase (SEQ ID NO: 83) | |
| 175 | slpB (SEQ ID NO: 85) | |
| 640 | Enzyme I for CCR (SEQ ID NO: 87) | |
| 185 | Phosphoglycerate mutase (SEQ ID NO: 89) | |
| 956 | Phosphofructokinase (SEQ ID NO: 91) | |
| 958 | (SEQ ID NO: 93) | |
| 289 | Elongation factor (SEQ ID NO: 95) | Elongation |
| 1763 | Peptidase (SEQ ID NO: 97) | |
| 324 | Ribosomal Protein (SEQ ID NO: 99) | |
| 698 | Glyceraldehyde 3P dehydrogenase (SEQ ID NO: 101) | |
| 1511 | (SEQ ID NO: 103) | |
| 778 | ATP synthase (SEQ ID NO: 105) | |
| 297 | 30S ribosomal protein (SEQ ID NO: 107) | |
| 1956 | (SEQ ID NO: 109) | Transport |
| 968 | 30S ribosomal protein (SEQ ID NO: 111) | |
| 699 | Phosphoglycerate kinase (SEQ ID NO: 113) | |
| 786 | 30S ribosomal protein (SEQ ID NO: 115) | |
| 265 | Ribosomal Protein (SEQ ID NO: 117) | |

TABLE 1-continued

Most highly induced *Lactobacillus acidophilus* NCFM genes in the presence of fructooligosaccharides.

| ORF# | Gene | Function |
|---|---|---|
| 288 | Ribosomal Protein (SEQ ID NO: 119) | |
| 1338 | 50S Protein (SEQ ID NO: 121) | |
| 224 | Ribose P pyrophosphatase (SEQ ID NO: 123) | |
| 8 | Single stranded DNA binding protein (SEQ ID NO: 125) | |
| 752 | Glucose 6P isomerase (SEQ ID NO: 127) | |
| 1974 | Pyruvate oxidase (SEQ ID NO: 129) | |
| 1300 | Oligopeptide ABC transporter (SEQ ID NO: 131) | Transport |
| 841 | 30S ribosomal protein (SEQ ID NO: 133) | |
| 697 | Regulator of glycolysis (SEQ ID NO: 135) | |
| 284 | RNA polymerase (SEQ ID NO: 137) | |
| 1436 | Glycerol uptake facilitator (SEQ ID NO: 139) | |
| 776 | ATPase (SEQ ID NO: 141) | |
| 1376 | Membrane protein (SEQ ID NO: 143) | |
| 777 | ATP synthase (SEQ ID NO: 145) | |
| 772 | ATPase (SEQ ID NO: 147) | |
| 285 | Ribosomal Protein (SEQ ID NO: 149) | |
| 291 | Ribosomal Protein (SEQ ID NO: 151) | |
| 775 | ATPase (SEQ ID NO: 153) | |
| 311 | Protein translocase (SEQ ID NO: 155) | |
| 369 | 50S Protein (SEQ ID NO: 157) | |
| 7 | Single stranded DNA binding protein (SEQ ID NO: 159) | |
| 317 | RNA polymerase (SEQ ID NO: 161) | |
| 303 | Ribosomal Protein (SEQ ID NO: 163) | |
| 305 | Ribosomal Protein (SEQ ID NO: 165) | |
| 307 | Ribosomal Protein (SEQ ID NO: 167) | |
| 1242 | Adenine phosphoribosyltransferase (SEQ ID NO: 169) | |
| 500 | Sucrose operon repressor (SEQ ID NO: 171) | |

The following Examples are provided to more fully illustrate the present invention, and are not to be construed as limiting thereof.

EXAMPLE 1

Functional and Comparative Genomic Analyses of an Operon Involved in Fructooligosaccharide Utilization by *Lactobacillus acidophilus*

The ability of select intestinal microbes to utilize substrates non-digested by the host may play an important role in their ability to successfully colonize the mammalian gastrointestinal (GI) tract. A diverse carbohydrate catabolic potential is associated with cariogenic activity of *S. mutans* in the oral cavity (1), adaptation of *L. plantarum* to a variety of environmental niches (2), and residence of *B. longum* in the colon (3), illustrating the competitive benefits of complex sugar utilization. Prebiotics are non-digestible food ingredients that selectively stimulate the growth and/or activity of beneficial microbial strains residing in the host intestine (4). Among sugars that qualify as prebiotics, fructo-oligosaccharides (FOS) are a diverse family of fructose polymers used commercially in food products and nutritional supplements, that vary in length and can be either derivatives of simple fructose polymers, or fructose moieties attached to a sucrose molecule. The linkage and degree of polymerization can vary widely (usually between 2 and 60 moieties), and several names such as inulin, levan, oligofructose and neosugars are used accordingly. The average daily intake of such compounds, originating mainly from wheat, onion, artichoke, banana, and asparagus (4, 5), is fairly significant with nearly 2.6 g of inulin and 2.5 g of oligofructose consumed in the average American diet (5). FOS are not digested in the upper gastrointestinal tract and can be degraded by a variety of lactic acid bacteria (6-9), residing in the human lower gastrointestinal tract (4, 10). FOS and other oligosaccharides have been shown in vivo to beneficially modulate the composition of the intestinal microbiota, and specifically to increase bifidobacteria and lactobacilli (4, 10, 11). A variety of *L. acidophilus* strains in particular have been shown to utilize several polysaccharides and oligosaccharides such as arabinogalactan, arabinoxylan and FOS (6, 9).

In silico analysis of a particular locus within the *L. acidophilus* NCFM genome revealed the presence of a gene cluster encoding proteins potentially involved in prebiotic transport and hydrolysis. This specific cluster was analyzed computationally and functionally to reveal the genetic basis for FOS transport and catabolism by *L. acidophilus* NCFM.

EXAMPLE 2

Bacterial Strain and Media

The strain used in this study is *L. acidophilus* NCFM (12). Cultures were propagated at 37° C., aerobically in MRS broth (Difco). A semi-synthetic medium consisted of: 1% bactopeptone (w/v) (Difco), 0.5% yeast extract (w/v) (Difco), 0.2% dipotassium phosphate (w/v) (Fisher), 0.5% sodium acetate (w/v) (Fisher), 0.2% ammonium citrate (w/v) (Sigma), 0.02% magnesium sulfate (w/v) (Fisher), 0.005% manganese sulfate (w/v) (Fisher), 0.1% Tween 80 (v/v) (Sigma), 0.003% bromocresol purple (v/v) (Fisher), and 1% sugar (w/v). The carbohydrates added were either glucose (dextrose) (Sigma), fructose (Sigma), sucrose (Sigma), or FOS. Two types of complex sugars were used as FOS: a $GF_n$ mix (manufactured by R. Hutkins), consisting of glucose monomers linked α-1,2 to two, three or four fructosyl moieties linked β-2,1, to form kestose ($GF_2$), nystose ($GF_3$) and fructofuranosyl-nystose ($GF_4$), respectively; and an $F_n$ mix, raftilose, derived from inulin hydrolysis (Orafti). Without carbohydrate supplementation, the semi-synthetic medium was unable to sustain bacterial growth above $OD_{600nm}$~0.2.

EXAMPLE 3

Computational Analysis of the Putative msm Operon

A 10 kbp DNA locus containing a putative msm (multiple sugar metabolism) operon was identified from the *L. acidophilus* NCFM genome sequence. ORF predictions were carried out by four computational programs: Glimmer (13, 14), Clone Manager (Scientific and Educational Software), the NCBI ORF caller, and GenoMax (InforMax Inc., MD). Glimmer was previously trained with a set of *L. acidophilus* genes available in public databases. The predicted ORFs were translated into putative proteins that were submitted to BlastP analysis (15).

EXAMPLE 4

RNA Isolation and Analysis

Total RNA was isolated using TRIzol (GibcoBRL) by following the instructions of the supplier. Cells in the mid-log phase were harvested by centrifugation (2 minutes, 14,000 rpm) and cooled on ice. Pellets were resuspended in TRIZOL, by vortexing and underwent five cycles of 1 min bead beating and 1 min on ice. Nucleic acids were subsequently purified using three chloroform extractions, and precipitated using isopropanol and centrifugation for 10 min at 12,000 rpm. The RNA pellet was washed with 70% ethanol, and resuspended into DEPC treated water. RNA samples were treated with DNAse I according to the instructions of the supplier (Boehringer Mannheim). First strand cDNA was synthesized using the Invitrogen RT-PCR kit according to the instruction of the suppliers. cDNA products were subsequently amplified using PCR with primers internal to genes of interest. For RNA slot blots, RNA samples were transferred to nitrocellulose membranes (BioRad) using a slot blot apparatus (Bio-Dot SF, BioRad), and the RNAs were UV crosslinked to the membranes. Blots were probed with DNA fragments generated by PCR that had been purified from agarose gels (GeneClean III kit, Midwest Scientific). Probes were labeled with $\alpha\text{-}^{32}P$, using the Amersham Multiprime Kit, and consisted of a 700 bp and 750 bp fragment internal to the msmE and bfrA genes, respectively. Hybridization and washes were carried out according to the instructions of the supplier (Bio-Dot Microfiltration Apparatus, BioRad) and radioactive signals were detected using a Kodak Biomax film. Primers are listed in Table 3.

EXAMPLE 5

Comparative Genomic Analysis

A gene cluster bearing a fructosidase gene was selected after computational data-mining of the *L. acidophilus* NCFM genome. Additionally, microbial clusters containing fructosidase EC 3.2.1.26 orthologs, or bearing an ABC transport system associated with an alpha-galactosidase EC 3.2.1.22 were selected from public databases (NCBI, TIGR). The sucrose operon is a widely distributed cluster, consisting of either three or four elements, namely: a regulator, a sucrose PTS transporter, a sucrose hydrolase and occasionally a fructokinase. Two gene cluster alignments were generated: (i) a PTS alignment, representing similarities over the sucrose operon, bearing a PTS transport system associated with a sucrose hydrolase; (ii) an ABC alignment, representing similarities over the multiple sugar metabolism cluster, bearing an ABC transport system usually associated with a galactosidase. Sequence information is available in Table 4.

EXAMPLE 6

Phylogenetic Trees

Nucleotide and protein sequences were aligned computationally using the CLUSTALW algorithm (16). The multiple alignment outputs were used for generating unrooted neighbor-joining phylogenetic trees using MEGA2 (17). In addition to a phylogenetic tree derived from 16S rRNA genes, trees were generated for ABC transporters, PTS transporters, transcription regulators, fructosidases, and fructokinases.

EXAMPLE 7

Gene Inactivation

Gene inactivation was conducted by site-specific plasmid integration into the *L. acidophilus* chromosome via homologous recombination (18). Internal fragments of the msmE and bfrA genes were cloned into pORI28 using *E. coli* as a host (19), and the constructs were subsequently purified and transformed into *L. acidophilus* NCFM. The ability of the mutant strains to grow on a variety of carbohydrate substrates was investigated using growth curves. Strains were grown on semi-synthetic medium supplemented with 0.5% w/v carbohydrate.

EXAMPLE 8

Computational Analysis of the msm Operon

Analysis of the msm locus using four ORF calling programs revealed the presence of seven putative ORFs. Because most of the encoded proteins were homologous to those of the msm operon present in *S. mutans* (20), a similar gene nomenclature was used. The analysis of the predicted ORFs suggested the presence of a transcriptional regulator of the LacI repressor family, MsmR (SEQ ID NO:172); a four component transport system of the ATP binding cassette (ABC) family, MsmEFGK (SEQ ID NOS:2, 4, 6, 10); and two enzymes involved in carbohydrate metabolism, namely a fructosidase EC 3.2.1.26, BfrA (SEQ ID NO:8); and a sucrose phosphorylase EC 2.4.1.7, GtfA (SEQ ID NO:12). A putative Shine-Dalgarno sequence 5'AGGAGG3' was found within 10 bp upstream of the msmE start codon. A dyad symmetry analysis revealed the presence of two stem loop structures that could act as putative Rho-independent transcriptional terminators: one between msmK and gtfA (between bp 6986 and 7014), free energy $-13.6$ kcal·$mol^{-1}$, and one 20 bp downstream of the last gene of the putative operon (between bp 8,500 and 8,538), free energy—$16.5$ kcal·$mol^{-1}$. The operon structure is shown in FIG. 1.

The regulator (SEQ ID NO:172) contained two distinct domains: a DNA binding domain at the amino-terminus with a predicted helix-turn-helix motif (pfam00354), and a sugar-binding domain at the carboxy-terminus (pfam00532). The transport elements consisted of a periplasmic solute binding protein (pfam01547), two membrane spanning permeases (pfam00528), and a cytoplasmic nucleotide binding protein (pfam 00005), characteristic of the different subunits of a typical ABC transport system (21). A putative anchoring motif LSLTG (SEQ ID NO:201) was present at the amino-terminus of the substrate-binding protein. Each permease contained five trans-membrane regions predicted computationally (22). Analyses of ABC transporters in recently sequenced microbial genomes have defined four characteristic sequence motifs (23, 24). The predicted MsmK (SEQ ID NO:10) protein included all four ABC conserved motifs, namely: Walker A: GPSGCGKST (SEQ ID NO:202) (consensus GxxGxGKST, SEQ ID NO:203; or [AG]xxxxGK[ST], SEQ ID NO:204); Walker B: IFLMDEPLSNLD (SEQ ID NO:205) (consensus hhhhDEPT, SEQ ID NO:206; or DexxxxxD, SEQ ID NO:207); ABC signature sequence: LSGG (SEQ ID NO:208); and Linton and Higgins motif: IAKLHQ (SEQ ID NO:209) (consensus hhhhH+/−, SEQ ID NO:210, with h, hydrophobic and +/−charged residues). The putative fructosidase (SEQ ID NO:8) showed high similarity to glycosyl hydrolases (pfam 00251). The putative sucrose phosphorylase (SEQ ID NO:12) shared 63% residue identity with that of S. mutans.

EXAMPLE 9

Sugar Induction and Co-Expression of Contiguous Genes

Figure 2A:
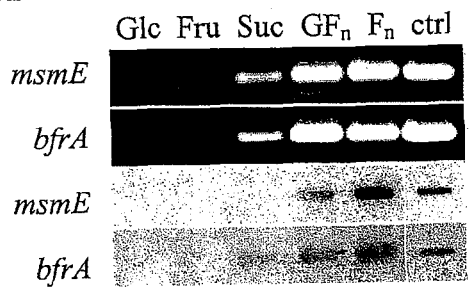
FIGS. 2A & 2B. Sugar induction and repression.
Figure 2B:
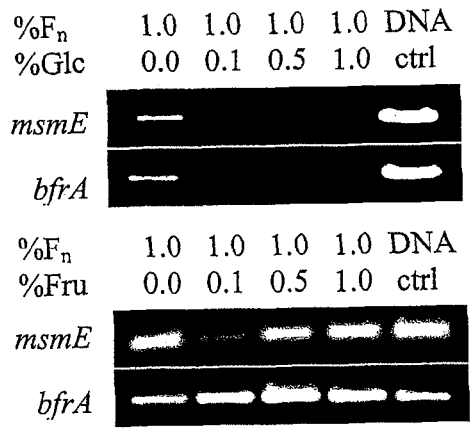
Figure 6:
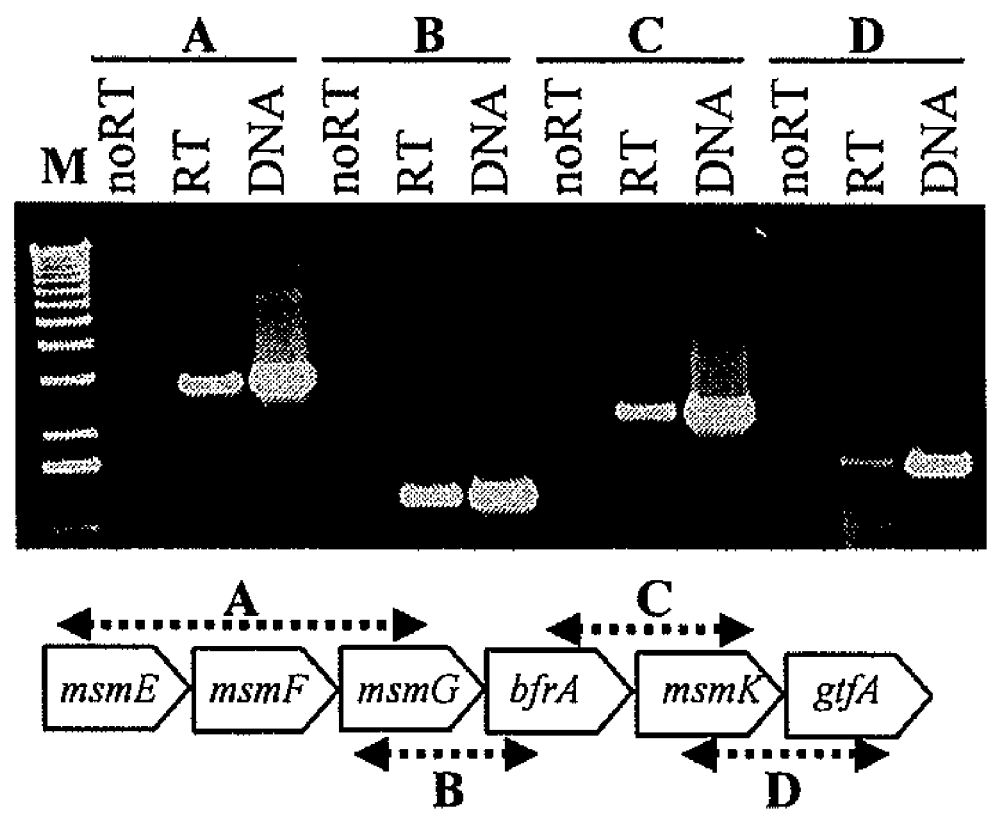
FIG. 6. Co-expression of contiguous genes. Co-transcription of contiguous genes was monitored by RT-PCR using primers as shown on the lower panel. In each set of three bands, a negative control did not undergo reverse transcription (left), and a positive control was obtained from chromosomal DNA used as a template for PCR (right).

Transcriptional analysis of the msm operon using RT-PCR and RNA slot blots showed that sucrose and both types of oligofructose ($GF_n$ and $F_n$) were able to induce expression of msmE (SEQ ID NO:2) and bfrA (SEQ ID NO:8) (FIG. 2A). In contrast, glucose and fructose did not induce transcription of those genes, suggesting specificity for non-readily fermentable sugars and the presence of a regulation system based on carbohydrate availability. In the presence of both FOS and readily fermentable sugars, glucose repressed expression of msmE (SEQ ID NO:2), even if present at a lower concentration, whereas fructose did not (FIG. 2B). Analysis of the transcripts induced by oligofructose indicated that all genes within the operon are co-expressed (FIG. 6) in a manner consistent with the S. mutans msm operon (25).

EXAMPLE 10

Mutant Phenotype Analysis

The ability of the bfrA (fructosidase) (SEQ ID NO:8) and msmE (ABC transporter) (SEQ ID NO:2) mutant strains to grow on a variety of carbohydrates was monitored by both optical density at 600 nm and colony forming units (cfu). The mutants retained the ability to grow on glucose, fructose, sucrose, galactose, lactose and FOS-GFn, in a manner similar to that of the control strain (FIG. 7), a lacZ mutant of the L. acidophilus parental strain also generated by plasmid integration (18). This strain was chosen because it also bears a copy of the plasmid used for gene inactivation integrated in the genome. In contrast, both the bfrA (SEQ ID NO:8) and msmE (SEQ ID NO:2) mutants halted growth on FOS-Fn prematurely (FIG. 3), likely upon exhaustion of simple carbohydrate from the semi-synthetic medium. After one passage, the msmE (SEQ ID NO:2) mutant displayed slower growth on FOS-$F_n$, while the bfrA (SEQ ID NO:8) mutant could not grow (FIG. 3). Additionally, terminal cell counts from overnight cultures grown on FOS-Fn were significantly lower for the mutants, especially after one passage (FIG. 7).

EXAMPLE 11

Comparative Genomic Analyses and Locus Alignments

Comparative genomic analysis of gene architecture between L. acidophilus, S. mutans, S. pneumoniae, B. subtilis and B. halodurans revealed a high degree of synteny within the msm cluster, except for the core sugar hydrolase (FIG. 4A). In contrast, gene content was consistent, whereas gene order was not well conserved for the sucrose operon (FIG. 4B). The lactic acid bacteria exhibit a divergent sucrose operon, where the regulator and the hydrolase are transcribed opposite to the transporter and the fructokinase. In contrast, gene architecture was variable amongst the proteobacteria.

EXAMPLE 12

Catabolite Response Elements (cre) Analysis

Analysis of the promoter-operator region upstream of the msmE (SEQ ID NO:2) gene revealed the presence of two 17-bp palindromes separated by 30 nucleotides, showing high similarity to a consensus sequence for the cis-acting sites controlling catabolite repression in Gram positive bacteria, notably Bacillus subtilis (27-29). Several cre-like sequences highly similar to those found in B. subtilis and S. mutans (27-30) were also retrieved from the promoter-operator region of the L. acidophilus NCFM sucrose operon as well as that of the other msm locus (Table 2). Interestingly, sequences nearly identical to the cre-like elements found in the L. acidophilus msm operon, were found in the promoter-operator region of the msm locus in S. pneumoniae (Table 2). The promoter element was found to be inducible by GFn and Fn, but repressed by glucose (FIG. 1). The regulatory protein (ORF 500) (SEQ ID NO:172) and the intergenic region between ORF 500 and 502, encoding the promoter region and cre regulatory elements (SEQ ID NOS:174 and 175), could be used in expression vectors for controlled, inducible expression of heterologous sequences (e.g. antisense RNA, genes and proteins).

Discussion

The L. acidophilus NCFM msm operon encodes an ABC transporter associated with a fructosidase that are both induced in the presence of FOS. Sucrose and both types of oligofructose induced expression of the operon, whereas glucose and fructose did not. Additionally, glucose repressed expression of the operon, suggesting the presence of a regulation mechanism of preferred carbohydrate utilization based on availability. Specific induction by FOS and sucrose, and repression by glucose indicated transcriptional regulation, likely through cre present in the operator-promoter region, similar to those found in B. subtilis (28) and S. mutans (30). Catabolite repression is a mechanism widely distributed amongst Gram-positive bacteria, usually mediated in cis by catabolite response elements, and in trans by repressors of the LacI family, responsible for transcriptional repression of genes encoding catabolic enzymes in the presence of readily fermentable sugars (29, 31, 32).

A variety of enzymes have been associated with microbial utilization of fructo-oligosaccharides, namely: fructosidase EC 3.2.1.26 (33, 34), inulinase EC 3.2.1.7 (35-37), levanase EC 3.2.1.65 (38), fructofuranosidase EC 3.2.1.26 (39, 40, 41), fructanase EC 3.2.1.80 (7), and levan bihydrolase EC 3.2.1.64 (42, 43). Despite the semantic diversity, these enzymes are functionally related, and should be considered as members of the same β-fructosidase super-family that incorporates members of both glycosyl family 32 and 68 (44). All those enzymes share the conserved motif H-x(2)-P-x(4)-[LIVM]-N-D-P-N-G (SEQ ID NO:211), and are all involved in the hydrolysis of β-D-fructosidic linkages to release fructose. Generally, fructosidases across genera share approximately 25-30% identity and 35-50% similarity (30), with several regions widely conserved across the glycosyl hydrolase 32 family (44). The two residues shown to be involved in the enzymatic activity of fructan-hydrolases, namely Asp 47 and Cys 230 (33, 45), as well as motifs highly conserved in the beta-fructosidase superfamily, such as the NDPNG (SEQ ID NO:212), FRDP (SEQ ID NO:213), and ECP motifs (33, 44), were extremely well conserved amongst all fructosidase sequences (FIG. 8B).

Figure 5:
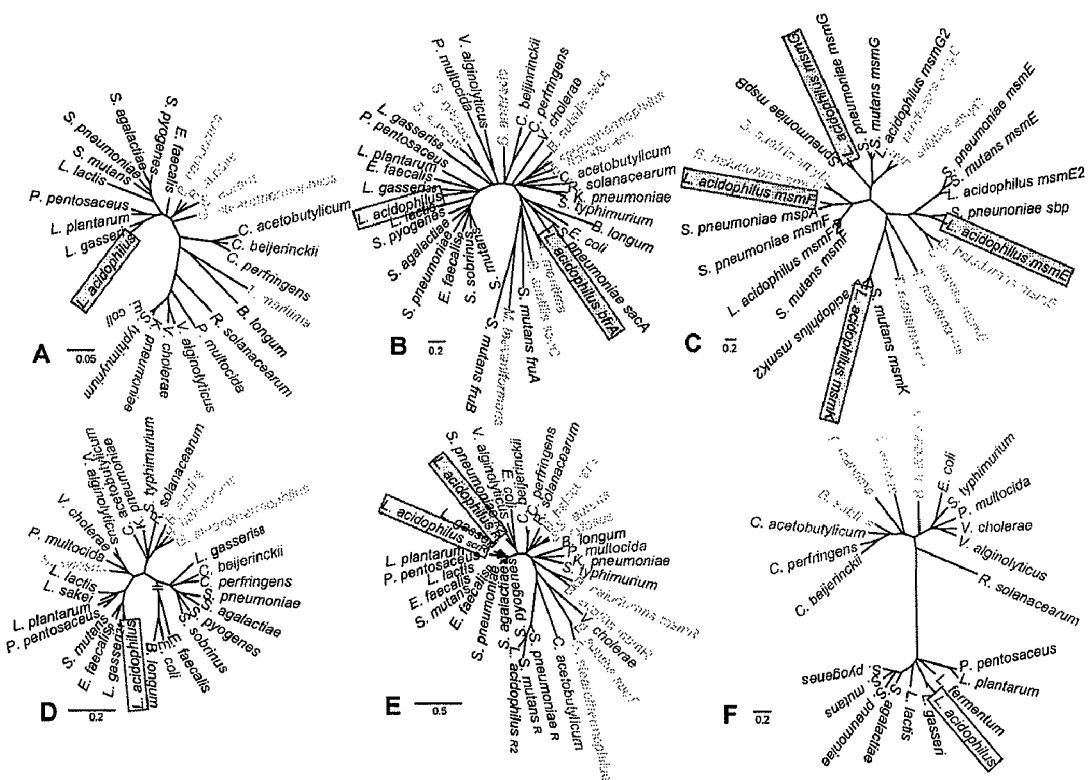
FIG. 5. Neighbor-joining phylogenetic trees. Lactobacillales, black; bacillales, green; clostridia, blue; thermotogae, yellow; proteobacteria, red. A, 16S; B, fructosidase; C, ABC; D, PTS; E, regulators; F, fructokinase. *L. acidophilus* proteins are boxed, and shaded when encoded by the msm locus. Bars indicate scales for computed pairwise distances.

Since the L. acidophilus fructosidase was similar to FruA of T. maritima and S. mutans (see FIG. 5B), two enzymes that have experimentally been associated with oligofructose hydrolysis (33, 34), we hypothesized that BfrA is responsible for FOS hydrolysis. Induction and gene inactivation data confirmed the correlation between the msm locus and FOS-related. The L. acidophilus BfrA fructosidase was most similar to that of T. maritima, which has the ability to release fructose from sucrose, raffinose, levan (β2,6) and inulin (β2, 1) in an exo-type manner (33). It was also very similar to other enzymes which have been characterized experimentally, and associated with hydrolysis of FOS compounds by S. mutans (30) and M. laevaniformans (43). Analysis of FOS degradation by S. mutans showed that FruA is involved in hydrolysis of levan, inulin, sucrose and raffinose (7, 20, 30, 34). Additionally, it was shown that expression of this gene was regulated by catabolite response elements (30, 32) and that fruA transcription was induced by levan, inulin and sucrose, whereas repressed by readily metabolizable hexoses (30, 34).

In S. mutans, FruA was shown to be an extracellular enzyme, which is anchored to the cell wall by a LPxTG (SEQ ID NO:214) motif (46), that catalyses the degradation of available complex carbohydrates outside of the cell. Additionally, microbial fructosidases associated with FOS hydrolysis such as M. laevaniformans LevM (43) and S. exfoliatus levanbiohydrolase (42) have been reported as extracellular enzymes as well. In contrast, the L. acidophilus NCFM fructosidase does not contain an anchoring signal, thus is likely a cytoplasmic enzyme requiring transport of its substrate(s) through the cell membrane. No additional secreted levanase or inulinase was found in the L. acidophilus genome sequence. Since transporter genes are often co-expressed with genes involved in the metabolism of the transported compounds (47), in silico analysis of the msm operon indicates that the substrate of the fructosidase is transported by an ABC transport system. This is rather unusual since when the fructosidase is not extracellular, the fructosidase gene is commonly associated with a sucrose PTS transporter (FIG. 4), notably in lactococci, streptococci and bacilli (48, 49), or a sucrose permease of the major facilitator family, as in B. longum. Those fructosidases usually associated with PTS transporters are generally sucrose-6-phosphate hydrolases that do not have FOS as cognate substrate. Therefore, L. acidophilus NCFM may have combined the ABC transport system usually associated with an alpha-galactosidase, with a fructosidases, in the msm locus. The genetic makeup of NCFM is seemingly distinct, and exclusively similar to that of S. pneumoniae. Additionally, recent evidence in L. paracasei suggested that an ABC transport system might be involved in FOS-related (50), which further supports the hypothesis that FOS is transported by an ABC transporter in L. acidophilus.

Lateral gene transfer (LGT) has increasingly been shown to account for a significant number of genes in bacterial genomes (51), and may account for a large proportion of the strain-specific genes found in microbes, as shown in H. pylori (52), C. jejuni (53), S. pneumoniae (54), and T. maritima (55). Notably, in T. maritima, genes involved in sugar transport and polysaccharide degradation represent a large proportion of variable genes, with ABC transporters having the highest horizontal gene transfer frequency (55). In addition, it was recently suggested that oligosaccharide catabolic capabilities of B. longum have been expanded through horizontal transfer, as part of its adaptation to the human GI tract (3), and that the large set of sugar uptake and utilization genes in L. plantarum was acquired through LGT (2).

Intestinal microbes would benefit greatly from acquisition of gene clusters involved in transport and catabolism of complex, undigested sugars, especially if they conferred a competitive edge towards successful colonization of the host GI tract.

Figure 9:
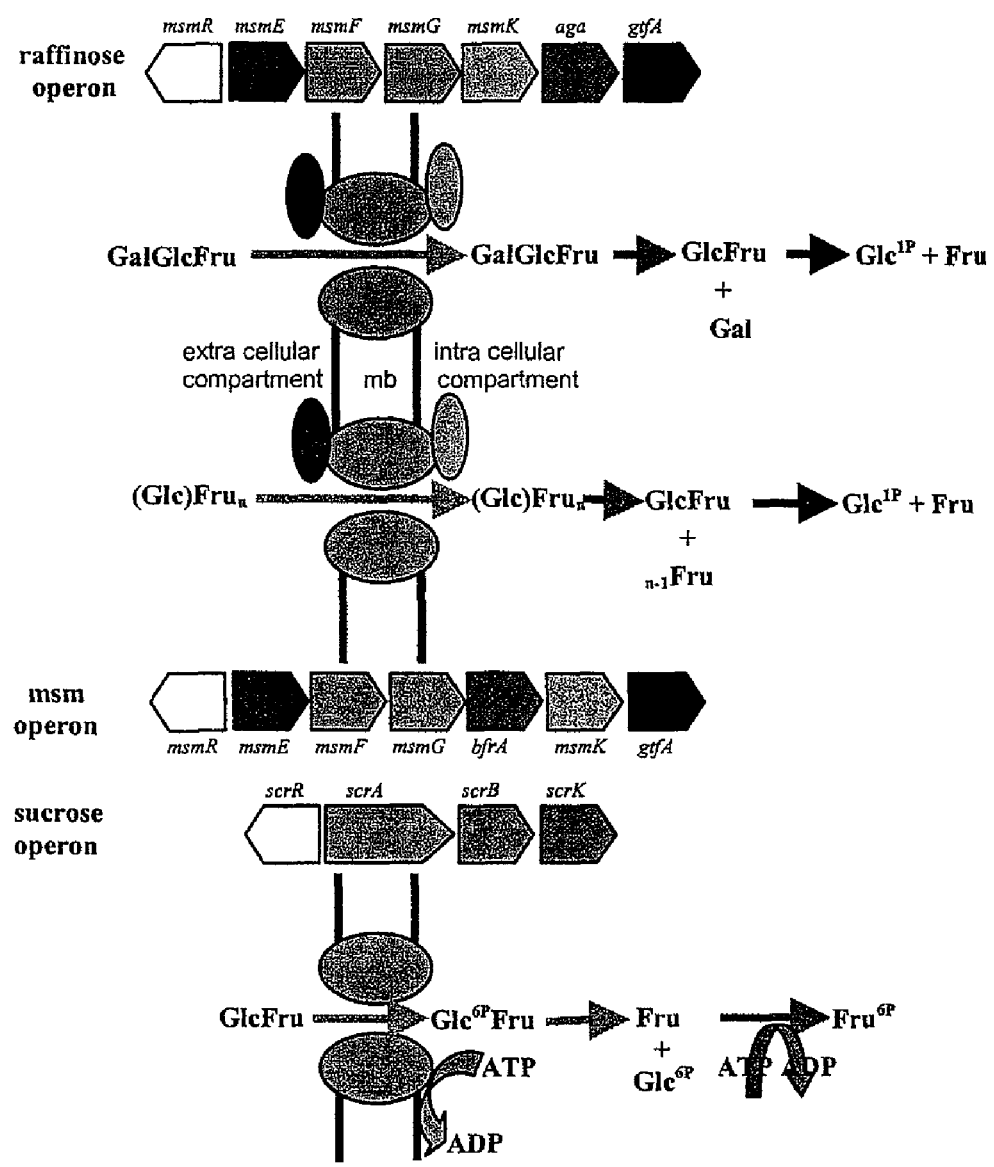
FIG. 9. Biochemical pathways. Biochemical pathways describing the likely reactions carried out by the enzymes encoded in the raffinose, msm and sucrose gene clusters. Each enzymatic reaction depicted on the pathways is carried out by a protein encoded by the gene of the same color. For the raffinose operon, raffinose is transported across the membrane by an ABC transporter, the alpha-galactosidase hydrolyses the galactose moiety, and the sucrose phosphorylase hydrolyses sucrose into glucose-1-phosphate and fructose. For the msm operon, FOS is transported across the membrane by an ABC transporter, the fructosidase hydrolyses fructose moieties, and the sucrose phosphorylase hydrolyses sucrose into glucose-1-phosphate and fructose. For the sucrose operon, sucrose is transported across the membrane and phosphorylated by a PTS transporter, the sucrose phosphate hydrolase hydrolyses the phosphorylated sucrose molecule into fructose and glucose-6-phosphate, and fructose is phosphorylated by the fructokinase.

L. acidophilus has combined the ABC transport system derived from the raffinose operon with a β-fructosidase to form a distinct gene cluster involved in transport and catabolism of prebiotic compounds including FOS, suggesting a possible adaptation of the sugar catabolism system towards different complex sugars. The catabolic properties of this operon might differ from those of the raffinose and sucrose operons (FIG. 9). In light of the theory that environmental factors and ecology might be dominant over phylogeny for variable genes (55), it is possible that L. acidophilus has acquired FOS-related capabilities through lateral gene transfer, or rearranged its genetic make-up to build a competitive edge towards colonization of the human GI tract by using prebiotic compounds, ultimately contributing to a more beneficial microbiota. This pathway is unique in that the complex carbohydrate is internalized by the bacterium, prior to the intracellular hydrolysis of individual sugar moieties (e.g. fructose). This process minimizes the availability of extracellular fermentable sugars to other competing microorganisms. In contrast, other FOS utilizing machineries promote FOS hydrolysis extracellularly. As a result, the FOS-related machinery of L. acidophilus can add a distinct competitive advantage to probiotic intestinal organisms when prebiotics are available. Moving the FOS operon to other beneficial probiotic or lactic acid bacteria can confer the ability to also internalize and then utilize FOS-like prebiotic compounds and improve their competitiveness in various ecosystems harboring complex carbohydrates as fermentation substrates.

EXAMPLE 13

Gapped BlastP Results for Amino Acid Sequences

A Gapped BlastP amino acid sequence alignment showed that SEQ ID NO:2 (415 amino acids) has about 94% identity from amino acids 1-415 with a protein from Lactobacillus acidophilus that is a substrate binding protein MsmE (Accession No. AAO21856.1), about 48% identity from amino acids 3-415 with a protein from Streptococcus pneumoniae that is an ABC transporter substrate-binding protein (Accession No. NP_359212.1), about 26% identity from amino acids 20-407 with a protein from Agrobacterium tumefaciens that is a sugar binding protein (Accession No. NP_396198.1), about 25% identity from amino acids 70-391 with a protein from Nostoc sp. that is a sugar ABC transporter sugar binding protein (Accession No. NP_488317.1), and about 25% identity from amino acids 70-391 with a protein from Nostoc punctiforme that is an ABC-type sugar transport system, periplasmic component (Accession No. ZP_00112296.1).

A Gapped BlastP amino acid sequence alignment showed that SEQ ID NO:4 (294 amino acids) has about 90% identity from amino acids 1-294 with a protein from *Lactobacillus acidophilus* that is a transmembrane permease MsmF (Accession No. AAO21857.1), about 57% identity from amino acids 10-269 with a protein from *Streptococcus pneumoniae* that is an ABC transporter membrane-spanning permease—sugar transporter (Accession No. NP_359211.1), about 40% identity from amino acids 11-268 with a protein from *Thermoanaerobacter tengcongensis* that is an ABC-type sugar transport system, permease component (Accession No. NP_622453.1), about 40% identity from amino acids 32-268 with a protein from *Listeria monocytogenes* that is similar to a putative sugar ABC transporter, permease protein (Accession No. NP_464293.1), and about 40% identity from amino acids 32-268 with a protein from *Listeria innocua* that is similar to a putative sugar ABC transporter, permease protein (Accession No. NP_470102.1).

A Gapped BlastP amino acid sequence alignment showed that SEQ ID NO:6 (285 amino acids) has about 96% identity from amino acids 1-285 with a protein from *Lactobacillus acidophilus* that is a transmembrane permease MsmG (Accession No. AAO21858.1), about 56% identity from amino acids 12-285 with a protein from *Streptococcus pneumoniae* that is an ABC transporter membrane-spanning permease-sugar transporter (Accession No. NP_359210.1), about 31% identity from amino acids 13-281 with a protein from *Listeria monocytogenes* that is similar to an ABC transporter, permease protein (Accession No. NP_464294.1), about 31% identity from amino acids 13-285 with a protein from *Listeria innocua* that is similar to a similar to an ABC transporter, permease protein (Accession No. NP_470103.1), and about 32% identity from amino acids 10-281 with a protein from *Listeria monocytogenes* that is similar to a sugar ABC transporter, permease protein (Accession No. NP_463711.1).

A Gapped BlastP amino acid sequence alignment showed that SEQ ID NO:8 (430 amino acids) has about 96% identity from amino acids 1-430 with a protein from *Lactobacillus acidophilus* that is a beta-fructosisdase (Accession No. AAO21859.1), about 34% identity from amino acids 2-429 with a protein from *Streptococcus pneumoniae* that is a putative sucrose-6-phosphate hydrolase (Accession No. NP_346228.1), about 34% identity from amino acids 2-429 with a protein from *Streptococcus pneumoniae* that is a sucrose-6-phosphate hydrolase (Accession No. NP_359209.1), about 31% identity from amino acids 12-406 with a protein from *Bacillus megaterium* that is similar to a beta-fructosidase FruA (Accession No. AAM19071.1), and about 34% identity from amino acids 18-373 with a protein from *Thermotoga maritima* that is similar to a beta-fructosidase (Accession No. NP_463711.1).

A Gapped BlastP amino acid sequence alignment showed that SEQ ID NO:10 (368 amino acids) has 100% identity from amino acids 1-368 with a protein from *Lactobacillus acidophilus* that is an ATP-binding protein MsmK (Accession No. AAO21860.1), about 86% identity from amino acids 1-366 with a protein from *Lactobacillus johnsonii* that is a multiple sugar ABC transporter ATPase component (Accession No. NP_964231.1), about 86% identity from amino acids 1-366 with a protein from *Lactobacillus gasseri* that is an ABC-type sugar transport system, ATPase component, (Accession No. ZP_00047081.1), about 74% identity from amino acids 1-366 with a protein from *Lactobacillus plantarum* that is a multiple sugar ABC transporter, ATP-binding protein (Accession No. NP_786829.1), and about 73% identity from amino acids 1-368 with a protein from *Lactobacillus acidophilus* that is an ATP-binding protein MsmK2 (Accession No. AAO21866.1).

A Gapped BlastP amino acid sequence alignment showed that SEQ ID NO:12 (490 amino acids) has 100% identity from amino acids 11-490 with a protein from *Lactobacillus acidophilus* that is a sucrose phosphorylase (Accession No. AAO21861.1), about 69% identity from amino acids 11-490 with a protein from *Lactobacillus acidophilus* that is a sucrose phosphorylase (Accession No. AAO21868.1), about 86% identity from amino acids 11-490 with a protein from *Lactobacillus johnsonii* that is a sucrose phosphorylase (Accession No. NP_964279.1), about 63% identity from amino acids 11-490 with a protein from *Streptococcus mutans* that is a sucrose phosphorylase (Accession No. AAA26937.1), and about 63% identity from amino acids 11-489 with a protein from *Streptococcus mutans* that is a gtfA protein (Accession No. BWSOGM).

A Gapped BlastP amino acid sequence alignment showed that SEQ ID NO:14 (421 amino acids) has 47% identity from amino acids 11-421 with a protein from *Streptococcus suis* that is a phosphoribosylamine-glycine ligase (Accession No. BAB63438.1), about 46% identity from amino acids 11-421 with a protein that is a phosphoribosylamine-glycine ligase (Accession No. Q9ZF44), about 46% identity from amino acids 11-421 with a protein from *Lactococcus lactis* that is a phosphoribosylamine-glycine ligase (Accession No. NP_267669.1), about 46% identity from amino acids 11-421 with a protein from *Streptococcus suis* that is a phosphoribosylamine-glycine ligase (Accession No. Q9F1S9), and about 63% identity from amino acids 11-489 with a protein from *Lactococcus lactis* that is purD (Accession No. CAA04374.1).

A Gapped BlastP amino acid sequence alignment showed that SEQ ID NO:16 (513 amino acids) has 64% identity from amino acids 1-513 with a protein from *Enterococcus faecium* that is an AICAR transformylase/IMP cyclohydrolase PurH (Accession No. ZP_00036573.1), about 64% identity from amino acids 1-513 with a protein from *Oenococcus oeni* that is an AICAR transformylase/IMP cyclohydrolase PurH (Accession No. ZP_00069316.1), about 46% identity from amino acids 2-513 with a protein from *Lactococcus plantarum* that is a bifunctional protein: phosphoribosylaminoimidazolecarboxamide formyltransferase; IMP cyclohydrolase (Accession No. CAD64957.1), about 63% identity from amino acids 2-513 with a protein from *Enterococcus faecalis* that is a phosphoribosylaminoimidazolecarboxamide formyltransferase/IMP cyclohydrolase (Accession No. NP_815479.1), and about 61% identity from amino acids 2-513 with a protein that is a bifunctional purine biosynthesis protein purH (Accession No. Q8DWK8).

A Gapped BlastP amino acid sequence alignment showed that SEQ ID NO:18 (200 amino acids) has 42% identity from amino acids 1-194 with a protein from *Enterococcus faecalis* that is a phosphoribosylglycinamide formyltransferase (Accession No. NP_815480.1), about 44% identity from amino acids 1-189 with a protein from *Enterococcus faecium* that is a folate-dependent phosphoribosylglycinamide formyltransferase PurN (Accession No. ZP_00036574.1), about 45% identity from amino acids 2-188 with a protein from *Streptocossus suis* that is a phosphoribosyl glycinamide transformylase-N (Accession No. BAB20826.1), about 43% identity from amino acids 2-191 with a protein from *Bacillus halodurans* that is a phosphoribosylglycinamide formyltransferase (Accession No. NP_241498.1), and about 38% identity from amino acids 2-189 with a protein from *Bacillus subtilis* that is a phosphoribosylglycinamide formyltransferase (Accession No. NP_388533.1).

A Gapped BlastP amino acid sequence alignment showed that SEQ ID NO:20 (345 amino acids) has 60% identity from amino acids 4-338 with a protein from *Bifidobacterium longum* that is a phosphoribosylaminoimidazole (AIR) synthetase (Accession No. ZP_00120963.1), about 60% identity from amino acids 2-335 with a protein from *Listeria innocua* that is a phosphoribosylaminoimidazole synthetase (Accession No. NP_471213.1), about 59% identity from amino acids 2-335 with a protein from *Lesteria monocytogenes* that is a phosphoribosylaminoimidazole synthetase (Accession No. NP_465292.1), about 56% identity from amino acids 2-345 with a protein from *Streptococcus agalactiae* that is unknown (Accession No. NP_734496.1), and about 57% identity from amino acids 2-335 with a protein from *Streptococcus pneumoniae* that is a phosphoribosylformylglycinamide cyclo-ligase (Accession No. NP_344596.1).

A Gapped BlastP amino acid sequence alignment showed that SEQ ID NO:22 (488 amino acids) has 64% identity from amino acids 10-488 with a protein from *Bifidobacterium longum* that is an amidophosphoribosyltransferase precursor (Accession No. NP_696292.1), about 64% identity from amino acids 10-484 with a protein from *Enterococcus faecalis* that is an amidophosphoribosyltransferase (Accession No. NP_815482.1), about 63% identity from amino acids 10-478 with a protein from *Streptococcus pyogenes* that is a putative phosphoribosylpyrophosphate amidotransferase (Accession No. NP_268443.1), about 63% identity from amino acids 10-478 with a protein from *Streptococcus pyogenes* that is a putative phosphoribosylpyrophosphate amidotransferase (Accession No. NP_606357.1), and about 63% identity from amino acids 10-478 with a protein from *Streptococcus pyogenes* that is a putative phosphoribosylpyrophosphate amidotransferase (Accession No. NP_663825.1).

A Gapped BlastP amino acid sequence alignment showed that SEQ ID NO:24 (742 amino acids) has 58% identity from amino acids 6-732 with a protein from *Enterococcus faecium* that is a phosphoribosylformylglycinamidine (FGAM) synthase (Accession No. ZP_00036504.1), about 56% identity from amino acids 1-742 with a protein from *Enterococcus faecalis* that is a phosphoribosylformylglycinamidine synthase II (Accession No. NP_815483.1), about 56% identity from amino acids 6-739 with a protein from *Listeria monocytogenes* that is a phosphoribosylformylglycinamidine synthetase I (Accession No. NP_465294.1), about 56% identity from amino acids 8-742 with a protein from *Bacillus subtilis* that is a phosphoribosylformylglycinamidine synthetase I (Accession No. NP_388530.1), and about 54% identity from amino acids 2-739 with a protein from *Lactobacillus plantarum* that is a phosphoribosylformylglycinamidine synthase II (Accession No. NP_786110.1).

A Gapped BlastP amino acid sequence alignment showed that SEQ ID NO:26 (223 amino acids) has 63% identity from amino acids 1-219 with a protein from *Listeria innocua* that is similar to phosphoribosylformylglycinamidine synthetase II (Accession No. NP_471216.1), about 63% identity from amino acids 1-219 with a protein from *Listeria monocytogenes* that is similar to phosphoribosylformylglycinamidine synthase II (Accession No. NP_465295.1), about 61% identity from amino acids 1-218 with a protein from *Listeria monocytogenes* that is a GATase, Glutamine amidotransferase class-I (Accession No. NP_654225.1), about 61% identity from amino acids 1-218 with a protein from *Bacillus cereus* that is a phosphoribosylformylglycinamidine synthase (Accession No. NP_388530.1), and about 61% identity from amino acids 1-218 with a protein from *Bacillus subtilis* that is a phosphoribosylformylglycinamidine synthetase II (Accession No. NP_388529.1).

A Gapped BlastP amino acid sequence alignment showed that SEQ ID NO:28 (84 amino acids) has 41% identity from amino acids 1-84 with a protein from *Lactococcus lactis* that is similar a hypothetical protein L177031 (Accession No. NP_267688.1), about 41% identity from amino acids 1-84 with a protein from *Lactococcus lactis* that is a conserved hypothetical protein (Accession No. T51699), about 34% identity from amino acids 1-81 with a protein from *Oenococcus oeni* that is a COG1828: phosphoribosylformylglycinamidine (FGAM) synthase, PurS component (Accession No. ZP_00069323.1), about 38% identity from amino acids 1-82 with a protein from *Enterococcus faecium* that is a COG1828: phosphoribosylformylglycinamidine (FGAM) synthase, PurS component (Accession No. ZP_00036502.1), and about 38% identity from amino acids 1-80 with a protein from *Enterococcus faecalis* that is a phosphoribosylformylglycinamidine synthase, PurS protein (Accession No. NP_815485.1).

A Gapped BlastP amino acid sequence alignment showed that SEQ ID NO:30 (238 amino acids) has 52% identity from amino acids 2-233 with a protein from *Listeria innocua* that is a phosphoribosylaminoimidazole succinocarboxamide synthetase (Accession No. NP_471218.1), about 50% identity from amino acids 5-236 with a protein from *Bifidobacterium longum* that is a hypothetical protein (Accession No. ZP_00120946.1), about 49% identity from amino acids 3-234 with a protein from *Fusobacterium nucleatum* that is a phosphoribosylamidoimidazole-succinocarboxamide synthase (Accession No. ZP_00144346.1), about 50% identity from amino acids 3-237 with a protein from *Enterococcus faecium* that is a COG0152: phosphoribosylaminoimidazole-succinocarboxamide (SAICAR) synthase (Accession No. ZP_00036501.1), and about 52% identity from amino acids 1-233 with a protein from *Streptococcus mutans* that is a putative phosphoribosylaminoimidazole-succinocarboxamide synthase SAICAR synthetase (Accession No. NP_720512.1).

A Gapped BlastP amino acid sequence alignment showed that SEQ ID NO:32 (649 amino acids) has 93% identity from amino acids 1-649 with a protein from *Lactobacillus acidophilus* that is a sucrose PTS transporter (Accession No. AAO38866.1), about 75% identity from amino acids 1-646 with a protein from *Lactobacillus johnsonii* that is a phosphoenolpyruvate-dependent sugar phosphotransferase system EIIABC, sucrose specific protein (Accession No. NP_965736.1), about 60% identity from amino acids 1-645 with a protein from *Streptococcus mutans* that is a putative PTS system, sucrose-specific IIABC component (Accession No. NP_722158.1), about 57% identity from amino acids 1-645 with a protein from *Enterococcus faecium* that is a PTS system, IIABC component (Accession No. NP_816989.1), and about 54% identity from amino acids 1-646 with a protein from *Lactobacillus plantarum* that is a sucrose PTS, EIIBCA protein (Accession No. NP_784017.1).

A Gapped BlastP amino acid sequence alignment showed that SEQ ID NO:34 (175 amino acids) has about 31% identity from amino acids 126-173 with an unknown protein [environmental sequence] (Accession No. EAB82951.1).

A Gapped BlastP amino acid sequence alignment showed that SEQ ID NO:36 (250 amino acids) has 72% identity from amino acids 1-250 with a protein from *Lactobacillus johnsonii* that is a glycerol uptake facilitator protein (Accession No. NP_964552.1), about 63% identity from amino acids 1-250 with a protein from *Lactobacillus plantarum* that is a glycerol uptake facilitator protein (Accession No. NP_786656.1), about 50% identity from amino acids 1-248 with a protein from *Enterococcus faecium* that is a glycerol uptake facilitator (Major intrinsic protein family, Accession No. ZP_00035848.1), about 68% identity from amino acids 76-249 with a protein from *Lactobacillus gasseri* that is a glycerol uptake facilitator (Major intrinsic protein family, Accession No. ZP_00047280.1), and about 54% identity from amino acids 1-646 with a protein from *Bifidobacterium longum* that is a glycerol uptake facilitator (Major intrinsic protein family, Accession No. ZP_00120881.1).

A Gapped BlastP amino acid sequence alignment showed that SEQ ID NO:38 (393 amino acids) has 71% identity from amino acids 18-392 with a protein from *Lactobacillus gasseri* that is a predicted permease (Accession No. ZP_00046992.1), about 58% identity from amino acids 18-151 with a protein from *Escherichia coli* O157:H7 that is a putative receptor protein (Accession No. NP_311279.1), about 58% identity from amino acids 18-151 with a protein from *Escherichia coli* O157:H7 that is a putative receptor protein (Accession No. NP_288942.1), about 58% identity from amino acids 18-124 with a protein from *Escherichia coli* that is a similar to SwissProt Accession Number P45869 (Accession No. BAA16244.1), and about 23% identity from amino acids 18-266 with a protein from *Streptomyces avermitilis* that is a putative transport integral membrane protein (Accession No. NP_822690.1).

A Gapped BlastP amino acid sequence alignment showed that SEQ ID NO:40 (313 amino acids) has 71% identity from amino acids 4-313 with a protein from *Lactobacillus johnsonii* that is a hypothetical protein LJ0129 (Accession No. NP_964145.1), about 60% identity from amino acids 7-313 with a protein from *Lactobacillus gasseri* that is an ABC-type phosphate/phosphonate transport system, periplasmic component (Accession No. ZP_00046815.1), about 60% identity from amino acids 7-313 with a protein from *Lactobacillus johnsonii* that is a hypothetical protein LJ1815 (Accession No. NP_965794.1), about 63% identity from amino acids 28-312 with a protein from *Staphylococcus aureus* that is a hypothetical protein (Accession No. NP_370667.1), and about 63% identity from amino acids 28-312 with a protein from *Staphylococcus aureus* that is a hypothetical protein, similar to an alkylphosphonate ABC tranporter (Accession No. NP_644932.1).

A Gapped BlastP amino acid sequence alignment showed that SEQ ID NO:42 (257 amino acids) has 86% identity from amino acids 3-257 with a protein from *Lactobacillus gasseri* that is a ABC-type phosphate/phosphonate transport system, ATPase component (Accession No. ZP_00046960.1), about 84% identity from amino acids 3-257 with a protein from *Lactobacillus johnsonii* that is a phosphate/phosphonate ABC transporter ATPase component (Accession No. NP_964146.1), about 64% identity from amino acids 7-247 with a protein from *Staphylococcus epidermidis* that is a transport system protein (Accession No. NP_765810.1), about 63% identity from amino acids 6-247 with a protein from *Bacillus anthracis* that is an ABC transporter (Accession No. NP_657589.1), and about 62% identity from amino acids 6-247 with a protein from *Bacillus cereus* that is a phosphonate ABC transporter, ATP-binding protein (Accession No. NP_980019.1).

A Gapped BlastP amino acid sequence alignment showed that SEQ ID NO:44 (265 amino acids) has 80% identity from amino acids 3-265 with a protein from *Lactobacillus gasseri* that is an ABC-type phosphate/phosphonate ABC transporter system, permease component (Accession No. ZP_00046959.1), about 78% identity from amino acids 3-265 with a protein from *Lactobacillus johnsonii* that is a phosphate/phosphonate ABC transporter system, permease component (Accession No. NP_964147.1), about 46% identity from amino acids 10-263 with a protein from *Bacillus anthracis* that is a hypothetical protein predicted by GeneMark (Accession No. NP_657588.1), about 46% identity from amino acids 10-263 with a protein from *Bacillus cereus* that is a phosphonate ABC transporter, permease protein (Accession No. NP_980018.1), and about 49% identity from amino acids 22-263 with a protein from *Staphylococcus epidermidis* that is a phosphonate transport permease (Accession No. NP_644932.1).

A Gapped BlastP amino acid sequence alignment showed that SEQ ID NO:46 (270 amino acids) has 78% identity from amino acids 1-270 with a protein from *Lactobacillus gasseri* that is an -type phosphate/phosphonate transport system, permease component (Accession No. ZP_00046958.1), about 79% identity from amino acids 1-270 with a protein from *Lactobacillus johnsonii* that is a phosphate/phosphonate ABC transporter permease component (Accession No. NP_964148.1), about 46% identity from amino acids 12-270 with a protein from *Bacillus cereus* that is a phosphonate ABC transporter, permease protein (Accession No. NP_980017.1), about 46% identity from amino acids 15-270 with a protein from *Bacillus anthracis* that is a hypothetical protein predicted by GeneMark (Accession No. NP_657587.1), and about 46% identity from amino acids 12-270 with a protein from *Bacillus cereus* that is a phosphonates transport system permease protein phnE (Accession No. NP_833411.1).

A Gapped BlastP amino acid sequence alignment showed that SEQ ID NO:48 (435 amino acids) has 85% identity from amino acids 1-419 with a protein from *Lactobacillus johnsonii* that is a hypothetical protein LJ827 (Accession No. NP_965806.1), about 69% identity from amino acids 1-419 with a protein from *Lactobacillus johnsonii* that is a hypothetical protein LJ829 (Accession No. NP_965808.1), about 66% identity from amino acids 4-419 with a protein from *Enterococcus faecalis* that is a xanthine/uracil permeases family protein (Accession No. NP_816553.1), about 65% identity from amino acids 4-419 with a protein from *Enterococcus faecium* that is a permease (Accession No. ZP_00037212.1), and about 63% identity from amino acids 1-419 with a protein from *Lactobacillus johnsonii* that is a hypothetical protein LJ 1830 (Accession No. NP_965809.1).

A Gapped BlastP amino acid sequence alignment showed that SEQ ID NO:50 (667 amino acids) has 72% identity from amino acids 33-667 with a protein from *Lactobacillus johnsonii* that is a phosphoenolpyruvate-dependent sugar phosphotransferase system EIIABC (Accession No. NP_964612.1), about 70% identity from amino acids 24-573 with a protein from *Lactobacillus gasseri* that is a phosphotransferase system IIC component (Accession No. ZP_00045979.1), about 48% identity from amino acids 25-663 with a protein from *Lactobacillus plantarum* that is a beta-glucosides PTS, EIIABC (Accession No. NP_784082.1), about 46% identity from amino acids 30-665 with a protein from *Lactobacillus plantarum* that is a beta-glucosides PTS, EIIABC (Accession No. NP_786509.1), and about 42% identity from amino acids 25-661 with a protein from *Lactobacillus plantarum* that is a beta-glucosides PTS, EIIABC (Accession No. NP_784083.1).

A Gapped BlastP amino acid sequence alignment showed that SEQ ID NO:52 (241 amino acids) has 63% identity from amino acids 19-240 with a protein from *Lactobacillus johnsonii* that is a trehalose operon repressor (Accession No. NP_964611.1), about 62% identity from amino acids 19-240 with a protein from *Lactobacillus gasseri* that is a transcriptional regulator (Accession No. ZP_00045980.1), about 47% identity from amino acids 21-238 with a protein from *Bacillus subtilis* that is a GntR family transcriptional regulator (Accession No. NP_388663.1), about 43% identity from amino acids 22-239 with a protein from *Enterococcus faecium* that is a GntR family transcriptional regulator (Accession No. NP_816762.1), and about 43% identity from amino acids 22-237 with a protein from *Listeria innocua* that is similar to a GntR family transcriptional regulator (Accession No. NP_470558.1).

A Gapped BlastP amino acid sequence alignment showed that SEQ ID NO:54 (570 amino acids) has 77% identity from amino acids 17-568 with a protein from *Lactobacillus gasseri* that is a glycosidase (Accession No. ZP_00045981.1), about 77% identity from amino acids 17-568 with a protein from *Lactobacillus johnsonii* that is a trehalose-6-phosphate hydrolase (Accession No. NP_964610.1), about 66% identity from amino acids 18-566 with a protein from *Lactobacillus plantarum* that is an alpha-phosphotrehalase (Accession No. NP_784081.1), about 57% identity from amino acids 23-568 with a protein from *Streptococcus pneumoniae* that is a dextranase (Accession No. H98083), and about 57% identity from amino acids 23-568 with a protein from *Streptococcus pneumoniae* that is a putative dextran glucosidase DexS (Accession No. NP_346315.1).

A Gapped BlastP amino acid sequence alignment showed that SEQ ID NO:56 (269 amino acids) has 60% identity from amino acids 1-269 with a protein from *Lactobacillus johnsonii* that is a phosphoenolpyruvate-dependent sugar phosphotransferase system EIIC, probable mannose specific (Accession No. NP_965751.1), about 60% identity from amino acids 1-269 with a protein from *Lactobacillus gasseri* that is a phosphotransferase system, mannose/fructose/N-acetylgalactosamine-specific component IIC (Accession No. ZP_00046853.1), about 57% identity from amino acids 1-269 with a protein from *Oenococcus oeni* that is a phosphotransferase system, mannose/fructose/N-acetylgalactosamine-specific component IIC (Accession No. ZP_00069944.1), about 53% identity from amino acids 1-269 with a protein from *Enterococcus faecalis* that is a PTS system, mannose-specific IIC component (Accession No. NP_813832.1), and about 52% identity from amino acids 1-269 with a protein from *Listeria innocua* that is similar to a PTS system mannose-specific, factor IIC (Accession No. NP_469489.1).

A Gapped BlastP amino acid sequence alignment showed that SEQ ID NO:58 (307 amino acids) has 75% identity from amino acids 4-284 with a protein from *Lactobacillus gasseri* that is a phosphotransferase system, mannose/fructose/N-acetylgalactosamine-specific component IID (Accession No. ZP_00046854.1), about 74% identity from amino acids 4-284 with a protein from *Lactobacillus johnsonii* that is a phosphoenolpyruvate-dependent sugar phosphotransferase system EIID probable mannose specific (Accession No. NP_965750.1), about 72% identity from amino acids 5-284 with a protein from *Enterococcus faecalis* that is a PTS system, mannose-specific IID component (Accession No. NP_813833.1), about 68% identity from amino acids 5-284 with a protein from *Listeria innocua* that is similar to a PTS system mannose-specific, factor IID (Accession No. NP_469490.1), and about 68% identity from amino acids 5-284 with a protein from *Listeria monocytogenes* that is similar to a PTS system mannose-specific, factor IID (Accession No. NP_463631.1).

A Gapped BlastP amino acid sequence alignment showed that SEQ ID NO:60 (432 amino acids) has 64% identity from amino acids 1-432 with a protein from *Lactobacillus johnsonii* that is a hypothetical protein LJ0453 (Accession No. NP_964478.1), about 55% identity from amino acids 1-432 with a protein from *Lactobacillus johnsonii* that is a hypothetical protein LJ0659 (Accession No. NP_965596.1), about 53% identity from amino acids 1-432 with a protein from *Lactobacillus gasseri* that is an ABC-type sugar transport system, periplasmic component (Accession No. ZP_00046334.1), about 52% identity from amino acids 1-432 with a protein from *Lactobacillus gasseri* that is an ABC-type sugar transport system, periplasmic component (Accession No. ZP_00046816.1), and about 47% identity from amino acids 1-432 with a protein from *Enterococcus faecalis* that is an ABC transporter, substrate-binding protein (Accession No. NP_816521.1).

A Gapped BlastP amino acid sequence alignment showed that SEQ ID NO:62 (135 amino acids) has 91% identity from amino acids 1-134 with a protein from *Lactobacillus johnsonii* that is a 30S ribosomal protein S12 (Accession No. NP_964355.1), about 86% identity from amino acids 1-134 with a protein from *Lactobacillus plantarum* that is a ribosomal protein S12 (Accession No. NP_784720.1), about 85% identity from amino acids 1-134 with a protein from *Streptococcus gordonii* that is a 30S ribosomal protein S12 (Accession No. Q9F0R4), about 84% identity from amino acids 1-134 with a protein from *Oceanobacillus iheyensis* that is a 30S ribosomal protein S12 (Accession No. NP_691035.1), and about 84% identity from amino acids 1-134 with a protein from *Streptococcus gordonii* that is a ribosomal protein S12 (Accession No. AAG35708.1).

A Gapped BlastP amino acid sequence alignment showed that SEQ ID NO:64 (444 amino acids) has 90% identity from amino acids 49-444 with a protein from *Lactobacillus acidophilus* that is an S-layer protein precursor (Accession No. P35829), about 67% identity from amino acids 49-443 with a protein from *Lactobacillus helveticus* that is a surface layer protein (Accession No. P38059), about 67% identity from amino acids 49-443 with a protein from *Lactobacillus helveticus* that is a surface layer protein (Accession No. CAB46984.1), about 66% identity from amino acids 49-443 with a protein from *Lactobacillus helveticus* that is a surface layer protein (Accession No. CAB46985.1), and about 66% identity from amino acids 49-443 with a protein from *Lactobacillus helveticus* that is a surface layer protein (Accession No. CAB46986.1).

A Gapped BlastP amino acid sequence alignment showed that SEQ ID NO:66 (443 amino acids) has 88% identity from amino acids 6-433 with a protein from *Lactobacillus johnsonii* that is an enolase (Accession No. NP_965216.1), about 88% identity from amino acids 6-433 with a protein from *Lactobacillus gasseri* that is an enolase (Accession No. ZP_00046557.1), about 70% identity from amino acids 6-408 with a protein from *Lactobacillus plantarum* that is a phosphopyruvate hydratase (Accession No. NP_785460.1), about 67% identity from amino acids 11-433 with a protein from *Lactobacillus johnsonii* that is an enolase (Accession No. NP_965101.1), and about 66% identity from amino acids 49-443 with a protein from *Lactobacillus helveticus* that is a surface layer protein (Accession No. CAB46986.1).

A Gapped BlastP amino acid sequence alignment showed that SEQ ID NO:68 (405 amino acids) has 88% identity from amino acids 10-405 with a protein from *Lactobacillus johnsonii* that is an elongation factor Tu (EF-Tu) (Accession No. NP_964865.1), about 82% identity from amino acids 13-405 with a protein from *Lactobacillus plantarum* that is an elongation factor Tu (Accession No. NP_785632.1), about 80% identity from amino acids 10-405 with a protein from

*Oenococcus oeni* that is a GTPase—translation elongation factor (Accession No. ZP_00069609.1), about 73% identity from amino acids 13-405 with a protein from *Geobacillus stearothermophilus* that is an elongation factor Tu (Accession No. O50306), and about 73% identity from amino acids 13-403 with a protein from *Lactococcus lactis* that is an elongation factor Tu (Accession No. NP_268018.1).

A Gapped BlastP amino acid sequence alignment showed that SEQ ID NO:70 (589 amino acids) has 85% identity from amino acids 1-589 with a protein from *Lactobacillus gasseri* that is a phosphohistidine swiveling domain (Accession No. ZP_00046514.1), about 85% identity from amino acids 1-589 with a protein from *Lactobacillus johnsonii* that is a pyruvate kinase (Accession No. NP_964936.1), about 83% identity from amino acids 1-589 with a protein from *Lactobacillus delbruecki* subsp. *lactis* that is a pyruvate kinase (Accession No. CAD56497.1), about 83% identity from amino acids 1-589 with a protein from *Lactobacillus debrueckii* that is a pyruvate kinase (Accession No. P34038), and about 65% identity from amino acids 1-589 with a protein from *Lactobacillus casei* that is a pyruvate kinase (Accession No. AAP72039.1).

A Gapped BlastP amino acid sequence alignment showed that SEQ ID NO:72 (665 amino acids) has 75% identity from amino acids 1-665 with a protein from *Lactobacillus johnsonii* that is a phosphoenolpyruvate-dependent sugar phosphotransferase system EIIABC, probable fructose specific (Accession No. NP_965683.1), about 75% identity from amino acids 1-665 with a protein from *Lactobacillus gasseri* that is a phosphotransferase system, fructose-specific IIC component (Accession No. ZP_00046644.1), about 56% identity from amino acids 1-656 with a protein from *Lactobacillus plantarum* that is a fructose PTS, EIIABC (Accession No. NP_785611.1), about 48% identity from amino acids 1-659 with a protein from *Oceanobacillus iheyensis* that is a PTS system fructose-specific enzyme II BC component (Accession No. NP_691759.1), and about 45% identity from amino acids 1-657 with a protein from *Streptococcus mutans* that is a IIABC fructose/xylitol-PTS (Accession No. AAM73727.1).

A Gapped BlastP amino acid sequence alignment showed that SEQ ID NO:74 (304 amino acids) has 79% identity from amino acids 1-303 with a protein from *Lactobacillus johnsonii* that is a fructose-1-phosphate kinase (Accession No. NP_965684.1), about 78% identity from amino acids 1-303 with a protein from *Lactobacillus gasseri* that is a fructose-1-phosphate kinase and related fructose-6-phosphate kinase (PfkB) (Accession No. ZP_00046643.1), about 55% identity from amino acids 1-304 with a protein from *Lactobacillus plantarum* that is a 1-phosphofructokinase (Accession No. NP_785610.1), about 51% identity from amino acids 1-304 with a protein from *Listeria monocytogenes* that is a fructose-1-phosphate kinase (Accession No. NP_465859.1), and about 51% identity from amino acids 1-304 with a protein from *Listeria innocua* that is a fructose-1-phosphate kinase (Accession No. NP_471760.1).

A Gapped BlastP amino acid sequence alignment showed that SEQ ID NO:76 (371 amino acids) has 87% identity from amino acids 1-323 with a protein from *Lactobacillus helveticus* that is an L-lactate dehydrogenase (Accession No. O32765), about 84% identity from amino acids 5-323 with a protein from *Lactobacillus gasseri* that is a malate/lactate dehydrogenase (Accession No. ZP_00047012.1), about 84% identity from amino acids 5-323 with a protein from *Lactobacillus johnsonii* that is an L-lactate dehydrogenase (Accession No. NP_964291.1), about 64% identity from amino acids 1-323 with a protein from *Lactobacillus sakei* that is an L-lactate dehydrogenase (Accession No. P50934), and about 64% identity from amino acids 8-323 with a protein from *Lactobacillus casei* that is an L-lactate dehydrogenase (Accession No. P00343).

A Gapped BlastP amino acid sequence alignment showed that SEQ ID NO:78 (238 amino acids) has 52% identity from amino acids 3-233 with a protein from *Listeria innocua* that is a phosphoribosylaminoimidazole succinocarboxamide synthetase (Accession No. NP_471218.1), about 50% identity from amino acids 5-236 with a protein from *Bifidobacterium longum* that is a hypothetical protein (Accession No. ZP_00120946.1), about 49% identity from amino acids 3-234 with a protein from *Fusobacterium nucleatum* that is a phosphoribosylamidoimidazole-succinocarboxamide synthase (Accession No. ZP_00144346.1), about 50% identity from amino acids 3-237 with a protein from *Enterococcus faecium* that is a phosphoribosylaminoimidazole-succinocarboxamide (SAICAR) synthase (Accession No. ZP_00036501.1), and about 52% identity from amino acids 1-233 with a protein from *Streptococcus mutans* that is a putative phosphoribosylaminoimidazole-succinocarboxamide synthase (Accession No. NP_720512.1).

A Gapped BlastP amino acid sequence alignment showed that SEQ ID NO:80 (251 amino acids) has 51% identity from amino acids 1-251 with a protein from *Lactobacillus johnsonii* that is a hypothetical protein LJ0570 (Accession No. NP_965685.1), about 52% identity from amino acids 1-251 with a protein from *Lactobacillus gasseri* that is a transcriptional regulator of sugar metabolism (Accession No. ZP_00046642.1), about 40% identity from amino acids 1-230 with a protein from *Bacillus subtilis* that is a transcriptional regulator (DeoR family) (Accession No. NP_389321.1), about 38% identity from amino acids 1-230 with a protein from *Bacillus halodurans* that is a transcriptional repressor (Accession No. NP_241692.1), and about 37% identity from amino acids 1-232 with a protein from *Clostridium perfringens* that is probably a transcriptional regulator (Accession No. NP_561502.1).

A Gapped BlastP amino acid sequence alignment showed that SEQ ID NO:82 (248 amino acids) has 84% identity from amino acids 19-248 with a protein from *Lactobacillus gasseri* that is a ribosomal protein L1 (Accession No. ZP_00047144.1), about 82% identity from amino acids 19-248 with a protein from *Lactobacillus johnsonii* that is a 50S ribosomal protein L1 (Accession No. NP_964436.1), about 68% identity from amino acids 19-243 with a protein from *Enterococcus faecalis* that is a ribosomal protein L1 (Accession No. NP_816350.1), about 63% identity from amino acids 19-247 with a protein from *Listeria monocytoigenes* that is a ribosomal protein L1 (Accession No. NP_463780.1), and about 62% identity from amino acids 19-247 with a protein from *Listeria innocua* that is a ribosomal protein L1 (Accession No. NP_469626.1).

A Gapped BlastP amino acid sequence alignment showed that SEQ ID NO:84 (349 amino acids) has 93% identity from amino acids 13-349 with a protein from *Lactobacillus gasseri* that is a lactate dehydrogenase and related dehydrogenases (Accession No. ZP_00046778.1), about 93% identity from amino acids 13-349 with a protein from *Lactobacillus johnsonii* that is an L-lactate dehydrogenase (Accession No. NP_964061.1), about 91% identity from amino acids 13-349 with a protein from *Lactobacillus helveticus* that is a D-lactate dehydrogenase (Accession No. P30901), about 83% identity from amino acids 13-342 with a protein from *Lactobacillus Bugaricus* that is a D-lactate dehydrogenase (Accession No. P26297), and about 83% identity from amino acids 13-342 with a protein from *Lactobacillus delbruekii* that is a D-lactate dehydrogenase (Accession No. CAA42781.1).

A Gapped BlastP amino acid sequence alignment showed that SEQ ID NO:86 (457 amino acids) has 88% identity from amino acids 1-457 with a protein from *Lactobacillus acidophilus* that is an SB-protein (Accession No. CAA61561.1), about 51% identity from amino acids 1-457 with a protein from *Lactobacillus acidophilus* that is an S-layer protein precursor (Accession No. P35829), about 44% identity from amino acids 1-456 with a protein from *Lactobacillus helveticus* that is a surface layer protein (Accession No. CAB46985.1), about 44% identity from amino acids 1-456 with a protein from *Lactobacillus helveticus* that is an S-layer protein precursor (Accession No. P38059), and about 44% identity from amino acids 1-456 with a protein from *Lactobacillus helveticus* that is a surface layer protein (Accession No. CAA63409.1).

A Gapped BlastP amino acid sequence alignment showed that SEQ ID NO:88 (577 amino acids) has 83% identity from amino acids 1-576 with a protein from *Lactobacillus gasseri* that is a phosphoenolpyruvate-protein kinase (Accession No. ZP_00046903.1), about 83% identity from amino acids 1-576 with a protein from *Lactobacillus johnsonii* that is a phosphoenolpyruvate-protein phosphotransferase (Accession No. NP_964672.1), about 68% identity from amino acids 1-573 with a protein from *Lactobacillus sakei* that is a phosphoenolpyruvate-protein phosphotransferase (Accession No. O07126), about 68% identity from amino acids 1-568 with a protein from *Lactobacillus casei* that is enzyme I (Accession No. AAF74347.1), and about 67% identity from amino acids 1-575 with a protein from *Streptococcus thermophilus* that is enzyme I (Accession No. AAP05990.1).

A Gapped BlastP amino acid sequence alignment showed that SEQ ID NO:90 (230 amino acids) has 97% identity from amino acids 1-230 with a protein from *Lactobacillus johnsonii* that is a phosphoglycerate mutase (Accession No. NP_964180.1), about 97% identity from amino acids 1-230 with a protein from *Lactobacillus gasseri* that is phosphoglycerate mutase 1 (Accession No. ZP_00047243.1), about 83% identity from amino acids 1-228 with a protein from *Lactobacillus plantarum* that is a phosphoglycerate mutase (Accession No. NP_786452.1), about 70% identity from amino acids 1-228 with a protein from *Oenococcus oeni* that is phosphoglycerate mutase 1 (Accession No. AAF74347.1), and about 67% identity from amino acids 1-225 with a protein from *Enterococcus faecalis* that is phosphoglycerate mutase 1 (Accession No. NP_813994.1).

A Gapped BlastP amino acid sequence alignment showed that SEQ ID NO:92 (320 amino acids) has 75% identity from amino acids 1-319 with a protein from *Lactobacillus johnsonii* that is a 6-phosphofructokinase (Accession No. NP_964935.1), about 72% identity from amino acids 1-319 with a protein from *Lactobacillus delbruekii* that is a 6-phosphofructokinase (Accession No. P80019), about 76% identity from amino acids 1-288 with a protein from *Lactobacillus gasseri* that is a 6-phosphofructokinase (Accession No. ZP_00046515.1), about 59% identity from amino acids 1-318 with a protein from *Lactobacillus casei* that is a phosphofructokinase (Accession No. AAP72038.1), and about 61% identity from amino acids 1-318 with a protein from *Lactobacillus plantarum* that is a phosphofructokinase (Accession No. NP_785441.1).

A Gapped BlastP amino acid sequence alignment showed that SEQ ID NO:94 (296 amino acids) has 75% identity from amino acids 1-296 with a protein from *Lactobacillus gasseri* that is an uncharacterized protein conserved in bacteria (Accession No. ZP_00046513.1), about 69% identity from amino acids 1-296 with a protein from *Lactobacillus johnsonii* that is a hypothetical protein LJ1081 (Accession No. NP_964937.1), about 46% identity from amino acids 1-295 with a protein from *Lactobacillus plantarum* that is unknown (Accession No. NP_785438.1), about 49% identity from amino acids 1-285 with a protein from *Enterococcus faecalis* that is a conserved hypothetical protein (Accession No. NP_815243.1), and about 45% identity from amino acids 2-279 with a protein from *Leuconostoc mesenteroides* that is an uncharacterized protein conserved in bacteria (Accession No. ZP_00064296.1).

A Gapped BlastP amino acid sequence alignment showed that SEQ ID NO:96 (697 amino acids) has 96% identity from amino acids 1-697 with a protein from *Lactobacillus johnsonii* that is an elongation factor G (Accession No. NP_964357.1), about 78% identity from amino acids 1-694 with a protein from *Lactobacillus plantarum* that is an elongation factor G (Accession No. NP_784722.1), about 71% identity from amino acids 5-693 with a protein from *Oenococcus oeni* that is a translation elongation factor (GTPase) (Accession No. ZP_00069473.1), about 70% identity from amino acids 5-696 with a protein from *Enterococcus faecalis* that is a translation elongation factor G (Accession No. NP_813999.1), and about 71% identity from amino acids 5-696 with a protein from *Streptococcus mutans* that is a translation elongation factor G (EF-G) (Accession No. NP_720811.1).

A Gapped BlastP amino acid sequence alignment showed that SEQ ID NO:98 (598 amino acids) has 86% identity from amino acids 1-598 with a protein from *Lactobacillus helveticus* that is an endopeptidase F (Accession No. AAQ72430.1), about 76% identity from amino acids 1-598 with a protein from *Lactobacillus gasseri* that is an oligoendopeptidase F (Accession No. ZP_00046654.1), about 71% identity from amino acids 1-598 with a protein from *Lactobacillus johnsonii* that is an oligoendopeptidease F (Accession No. NP_965674.1), about 49% identity from amino acids 3-598 with a protein from *Enterococcus faecalis* that is an oligoendopeptidase F, plasmid (Accession No. NP_813999.1), and about 50% identity from amino acids 3-596 with a protein from *Lactobacillus plantarum* that is an oligoendopeptidase F (Accession No. NP_720811.1).

A Gapped BlastP amino acid sequence alignment showed that SEQ ID NO:100 (131 amino acids) has 89% identity from amino acids 1-131 with a protein from *Lactobacillus johnsonii* that is a 30S ribosomal protein S9 (Accession No. NP_964392.1), about 86% identity from amino acids 22-131 with a protein from *Lactobacillus gasseri* that is a ribosomal protein S9 (Accession No. ZP_00047472.1), about 75% identity from amino acids 4-131 with a protein from *Lactobacillus plantarum* that is a ribosomal protein S9 (Accession No. NP_784764.1), about 71% identity from amino acids 4-131 with a protein from *Staphylococcus epidermidis* that is a 30S ribosomal protein S9 (Accession No. NP_765345.1), and about 70% identity from amino acids 4-131 with a protein from *Staphylococcus aureus* that is a 30S ribosomal protein S9 (Accession No. NP_372741.1).

A Gapped BlastP amino acid sequence alignment showed that SEQ ID NO:102 (338 amino acids) has 91% identity from amino acids 1-338 with a protein from *Lactobacillus johnsonii* that is a glyceraldehyde-3-phosphate dehydrogenase/erythrose-4-phosphate dehydrogenase (Accession No. ZP_00047412.1), about 86% identity from amino acids 1-338 with a protein from *Lactobacillus delbruekii* that is a glyceraldehyde 3-phosphate dehydrogenase (Accession No. O32755), about 79% identity from amino acids 1-338 with a protein from *Lactobacillus plantarum* that is a glyceraldehydes 3-phosphate dehydrogenase (Accession No. NP_784534.1), about 73% identity from amino acids 1-338 with a protein from *Enterococcus faecalis* that is a glyceraldehydes 3-phosphate dehydrogenase (Accession No. NP_815245.1), and about 69% identity from amino acids 1-338 with a protein from *Leiconostoc meseteroides* that is a glyceraldehyde-3-phosphate dehydrogenase/erythrose-4-phosphate dehydrogenase (Accession No. ZP_00063906.1).

A Gapped BlastP amino acid sequence alignment showed that SEQ ID NO:104 (309 amino acids) has 76% identity from amino acids 5-308 with a protein from *Lactobacillus gasseri* that is a predicted N-acetylglucosamine kinase (Accession No. ZP_00046339.1), about 75% identity from amino acids 5-308 with a protein from *Lactobacillus johnsonii* that is a hypothetical protein LJ0664 (Accession No. NP_965591.1), about 35% identity from amino acids 2-292 with a protein from *Lactobacillus gasseri* that is a predicted N-acetylglucosamine kinase (Accession No. ZP_00046810.1), about 35% identity from amino acids 5-294 with a protein from *Lactobacillus plantarum* that is a putative N-acetylglucosamine kinase (Accession NP_786717.1), and about 32% identity from amino acids 5-258 with a protein from *Bacillus cereus* that is an ATPase family protein (Accession No. NP_832159.1).

A Gapped BlastP amino acid sequence alignment showed that SEQ ID NO:106 (479 amino acids) has 94% identity from amino acids 1-479 with a protein from *Lactobacillus acidophilus* that is an F1F0-ATPase subunit beta (Accession No. AAF22498.1), about 86% identity from amino acids 1-478 with a protein from *Lactobacillus johnsonii* that is an ATP synthase beta chain (Accession No. NP_964795.1), about 78% identity from amino acids 2-468 with a protein from *Lactobacillus casei* that is an ATP synthase beta chain (Accession No. Q03234), about 77% identity from amino acids 1-464 with a protein from *Lactobacillus plantarum* that is an H(+)-transporting two-sector ATPase, beta subunit (Accession NP_785830.1), and about 77% identity from amino acids 1-465 with a protein that is an ATP synthase beta chain (Accession No. P43451).

A Gapped BlastP amino acid sequence alignment showed that SEQ ID NO:108 (224 amino acids) has 80% identity from amino acids 1-223 with a protein from *Lactobacillus johnsonii* that is a 30S ribosomal protein S3 (Accession No. NP_964365.1), about 80% identity from amino acids 1-223 with a protein from *Lactobacillus gasseri* that is a ribosomal protein S3 (Accession No. ZP_00047371.1), about 70% identity from amino acids 1-212 with a protein from *Enterococcus faecalis* that is a ribosomal protein S3 (Accession No. NP_814010.1), about 67% identity from amino acids 1-223 with a protein from *Lactobacillus plantarum* that is a ribosomal protein S3 (Accession No. NP_784730.1), and about 69% identity from amino acids 1-212 with a protein from *Enterococcus faecium* that is a ribosomal protein S3 (Accession No. ZP_00035541.1).

A Gapped BlastP amino acid sequence alignment showed that SEQ ID NO:108 (224 amino acids) has 80% identity from amino acids 1-223 with a protein from *Lactobacillus johnsonii* that is a 30S ribosomal protein S3 (Accession No. NP_964365.1), about 80% identity from amino acids 1-223 with a protein from *Lactobacillus gasseri* that is a ribosomal protein S3 (Accession No. ZP_00047371.1), about 70% identity from amino acids 1-212 with a protein from *Enterococcus faecalis* that is a ribosomal protein S3 (Accession No. NP_814010.1), about 67% identity from amino acids 1-223 with a protein from *Lactobacillus plantarum* that is a ribosomal protein S3 (Accession No. NP_784730.1), and about 69% identity from amino acids 1-212 with a protein from *Enterococcus faecium* that is a ribosomal protein S3 (Accession No. ZP_00035541.1).

A Gapped BlastP amino acid sequence alignment showed that SEQ ID NO:110 (430 amino acids) has 86% identity from amino acids 13-425 with a protein from *Lactobacillus johnsonii* that is a hypothetical protein LJ1829 (Accession No. NP_965808.1), about 87% identity from amino acids 13-383 with a protein from *Lactobacillus gasseri* that is a permease (Accession No. ZP_00047460.1), about 66% identity from amino acids 13-423 with a protein from *Lactobacillus johnsonii* that is a hypothetical protein LJ827 (Accession No. NP_965806.1), about 64% identity from amino acids 13-428 with a protein from *Lactobacillus johnsonii* that is a hypothetical protein LJ1830 (Accession No. NP_965809.1), and about 63% identity from amino acids 13-428 with a protein from *Lactobacillus gasseri* that is a permease (Accession No. ZP_00047457.1).

A Gapped BlastP amino acid sequence alignment showed that SEQ ID NO:112 (403 amino acids) has 77% identity from amino acids 1-402 with a protein from *Lactobacillus johnsonii* that is a ribosomal protein S1 (Accession No. NP_964946.1), about 79% identity from amino acids 1-241 with a protein from *Lactobacillus gasseri* that is a ribosomal protein S1 (Accession No. ZP_00046504.1), about 44% identity from amino acids 2-401 with a protein from *Lactobacillus plantarum* that is a ribosomal protein S1 (Accession No. NP_785427.1), about 44% identity from amino acids 4-403 with a protein from *Enterococcus faecalis* that is a ribosomal protein S1 (Accession No. NP_815265.1), and about 44% identity from amino acids 1-399 with a protein that is a ribosomal protein S1 homolog (Accession No. AAA77669.1).

A Gapped BlastP amino acid sequence alignment showed that SEQ ID NO:114 (408 amino acids) has 93% identity from amino acids 6-408 with a protein from *Lactobacillus johnsonii* that is a phosphoglycerate kinase (Accession No. NP_964728.1), about 92% identity from amino acids 6-408 with a protein from *Lactobacillus gasseri* that is a 3-phosphoglycerate kinase (Accession No. ZP_00047411.1), about 87% identity from amino acids 6-408 with a protein from *Lactobacillus delbruekii* that is a phosphoglycerate kinase (Accession No. O32756), about 86% identity from amino acids 6-408 with a protein from *Lactobacillus* delbruekii subsp. *lactis* that is a phosphoglycerate kinase (Accession No. Q8GIZ5), and about 71% identity from amino acids 6-408 with a protein from *Lactobacillus plantarum* that is a phosphoglycerate kinase (Accession No. NP_784535.1).

A Gapped BlastP amino acid sequence alignment showed that SEQ ID NO:116 (235 amino acids) has 81% identity from amino acids 21-235 with a protein from *Lactobacillus gasseri* that is a ribosomal protein S1 and related proteins (Accession No. ZP_00046255.1), about 82% identity from amino acids 33-235 with a protein from *Lactobacillus johnsonii* that is a 30S ribosomal protein S4 (Accession No. NP_964806.1), about 76% identity from amino acids 76-325 with a protein from *Enterococcus faecalis* that is a ribosomal protein S4 (Accession No. NP_816682.1), about 76% identity from amino acids 13-234 with a protein from *Lactobacillus plantarum* that is a ribosomal protein S4 (Accession No. NP_785803.1), and about 71% identity from amino acids 33-235 with a protein from *Streptococcus pyogenes* that is a ribosomal protein S4 (Accession No. NP_270088.1).

A Gapped BlastP amino acid sequence alignment showed that SEQ ID NO:118 (81 amino acids) has 88% identity from amino acids 1-79 with a protein from *Lactobacillus johnsonii* that is a 50S ribosomal protein L31 (Accession No.

NP_964285.1), about 88% identity from amino acids 1-79 with a protein from *Lactobacillus gasseri* that is a ribosomal protein L31 (Accession No. ZP_00047005.1), about 70% identity from amino acids 1-80 with a protein from *Streptococcus algalactiae* that is a ribosomal protein L31 (Accession No. NP_687565.1), about 68% identity from amino acids 1-80 with a protein from *Streptococcus pneumoniae* that is a ribosomal protein L31 (Accession No. NP_785803.1), and about 68% identity from amino acids 1-80 with a protein from *Streptococcus mutans* that is a 50S ribosomal protein L31 (Accession No. NP_721669.1).

A Gapped BlastP amino acid sequence alignment showed that SEQ ID NO:120 (156 amino acids) has 92% identity from amino acids 1-156 with a protein from *Lactobacillus johnsonii* that is a 30S ribosomal protein S7 (Accession No. NP_964356.1), about 74% identity from amino acids 1-156 with a protein from *Bacillus cereus* that is an SSU ribosomal protein S7P (Accession No. NP_830007.1), about 74% identity from amino acids 1-156 with a protein from *Bacillus anthracis* that is a ribosomal protein S7 (Accession No. NP_842674.1), about 75% identity from amino acids 1-156 with a protein from *Lactobacillus plantarum* that is a ribosomal protein L31 (Accession No. NP_784721.1), and about 74% identity from amino acids 1-156 with a protein from *Streptococcus mutans* that is a ribosomal protein S7 (Accession No. P22744).

A Gapped BlastP amino acid sequence alignment showed that SEQ ID NO:120 (156 amino acids) has 92% identity from amino acids 1-156 with a protein from *Lactobacillus johnsonii* that is a 30S ribosomal protein S7 (Accession No. NP_964356.1), about 74% identity from amino acids 1-156 with a protein from *Bacillus cereus* that is an SSU ribosomal protein S7P (Accession No. NP_830007.1), about 74% identity from amino acids 1-156 with a protein from *Bacillus anthracis* that is a ribosomal protein S7 (Accession No. NP_842674.1), about 75% identity from amino acids 1-156 with a protein from *Lactobacillus plantarum* that is a ribosomal protein L31 (Accession No. NP_784721.1), and about 74% identity from amino acids 1-156 with a protein from *Streptococcus mutans* that is a ribosomal protein S7 (Accession No. P22744).

A Gapped BlastP amino acid sequence alignment showed that SEQ ID NO:122 (103 amino acids) has 57% identity from amino acids 1-103 with a protein from *Lactobacillus johnsonii* that is a 50S ribosomal protein L21 (Accession No. NP_965358.1), about 51% identity from amino acids 1-103 with a protein from *Bacillus halodurans* that is a 50S ribosomal protein L21 (Accession No. NP_243877.1), about 50% identity from amino acids 1-103 with a protein from *Lactobacillus plantarum* that is a ribosomal protein L21 (Accession No. NP_785185.1), about 48% identity from amino acids 1-103 with a protein from *Azotobacter vinelandii* that is a ribosomal protein L21 (Accession No. ZP_00092023.1), and about 51% identity from amino acids 1-103 with a protein from *Bacillus subtilis* that is a ribosomal protein L21 (Accession No. NP_390674.1).

A Gapped BlastP amino acid sequence alignment showed that SEQ ID NO:124 (324 amino acids) has 85% identity from amino acids 1-319 with a protein from *Lactobacillus gasseri* that is a phosphoribosylpyrophosphate synthetase (Accession No. ZP_00047087.1), about 85% identity from amino acids 1-319 with a protein from *Lactobacillus johnsonii* that is a ribose-phosphate pyrophosphokinase (Accession No. NP_964225.1), about 77% identity from amino acids 9-323 with a protein from *Lactobacillus plantarum* that is a ribose-phosphate pyrophosphokinase (Accession No. NP_784259.1), about 73% identity from amino acids 9-317 with a protein from *Enterococcus faecium* that is a phosphoribosylpyrophosphate synthetase (Accession No. ZP_00036337.1), and about 70% identity from amino acids 9-317 with a protein from *Enterococcus faecalis* that is a ribose-phosphate pyrophosphokinase (Accession No. NP_816767.1).

A Gapped BlastP amino acid sequence alignment showed that SEQ ID NO:126 (176 amino acids) has 90% identity from amino acids 5-116 with a protein from *Lactobacillus johnsonii* that is a single-strand binding protein (Accession No. NP_964022.1), about 89% identity from amino acids 5-116 with a protein from *Lactobacillus gasseri* that is a single-stranded DNA-binding protein (Accession No. ZP_00046746.1), about 79% identity from amino acids 5-114 with a protein from *Lactobacillus plantarum* that is a single-strand binding protein (Accession No. NP_783874.1), about 74% identity from amino acids 5-116 with a protein from *Oenococcus oeni* that is a single-stranded DNA-binding protein (Accession No. ZP_00069201.1), and about 74% identity from amino acids 5-116 with a protein from *Leuconostoc mesenteroides* that is a single-stranded DNA-binding protein (Accession No. ZP_00063879.1).

A Gapped BlastP amino acid sequence alignment showed that SEQ ID NO:128 (445 amino acids) has 81% identity from amino acids 3-445 with a protein from *Lactobacillus gasseri* that is a glucose-6-phosphate isomerase (Accession No. ZP_00046229.1), about 81% identity from amino acids 3-445 with a protein from *Lactobacillus johnsonii* that is a glucose-6-phosphate isomerase (Accession No. NP_964779.1), about 70% identity from amino acids 1-445 with a protein from *Lactobacillus plantarum* that is a glucose-6-phosphate isomerase (Accession No. NP_785941.1), about 65% identity from amino acids 1-445 with a protein from *Lactobacillus fementum* that is a glucose-6-phosphate isomerase (Accession No. Q83XM3), and about 66% identity from amino acids 1-445 with a protein from *Streptococcus pneumoniae* that is a glucose-6-phosphate isomerase (Accession No. NP_359473.1).

A Gapped BlastP amino acid sequence alignment showed that SEQ ID NO:130 (601 amino acids) has 72% identity from amino acids 1-601 with a protein from *Lactobacillus gasseri* that are thiamine pyrophosphate-requiring enzymes (Accession No. ZP_00047198.1), about 68% identity from amino acids 1-601 with a protein from *Lactobacillus johnsonii* that is a pyruvate oxidase (Accession No. NP_965831.1), about 59% identity from amino acids 1-568 with a protein from *Lactobacillus plantarum* that is a pyruvate oxidase (Accession No. NP_784584.1), about 48% identity from amino acids 1-563 with a protein from *Lactococcus lactis* subsp. *lactis* that is a pyruvate oxidase (Accession No. NP_268201.1), and about 39% identity from amino acids 2-572 with a protein from *Lactobacillus plantarum* that is a pyruvate oxidase (Accession No. NP_786788.1).

A Gapped BlastP amino acid sequence alignment showed that SEQ ID NO:132 (585 amino acids) has 76% identity from amino acids 1-585 with a protein from *Lactobacillus gasseri* that is an ABC-type dipeptide transport system, periplasmic component (Accession No. ZP_00047309.1), about 75% identity from amino acids 1-585 with a protein from *Lactobacillus johnsonii* that is an oligopeptide ABC transporter solute-binding component (Accession No. NP_965324.1), about 70% identity from amino acids 1-585 with a protein from *Lactobacillus johnsonii* that is an oligopeptide ABC transporter solute-binding component (Accession No. NP_965325.1), about 73% identity from amino acids 82-585 with a protein from *Lactobacillus gasseri* that is an ABC-type dipeptide transport system, periplasmic component (Accession No. NP_ZP_00047310.1), and about 64% identity from amino acids 1-585 with a protein from *Lactobacillus delbrueckii* that is an oligopeptide binding protein OppA1 (Accession No. AAK72116.1).

A Gapped BlastP amino acid sequence alignment showed that SEQ ID NO:134 (90 amino acids) has 73% identity from amino acids 6-88 with a protein from *Lactobacillus johnsonii* that is a 30S ribosomal protein S20 (Accession No. NP_964861.1), about 73% identity from amino acids 6-88 with a protein from *Lactobacillus gasseri* that is a ribosomal protein S20 (Accession No. ZP_00046297.1), about 57% identity from amino acids 6-88 with a protein from *Enterococcus faecalis* that is a ribosomal protein S20 (Accession No. NP_816091.1), about 59% identity from amino acids 6-84 with a protein from *Lactobacillus plantarum* that is a ribosomal protein S20 (Accession No. NP_785638.1), and about 59% identity from amino acids 6-88 with a protein from *Listeria innocua* that is a ribosomal protein S20 (Accession No. NP_470851.1).

A Gapped BlastP amino acid sequence alignment showed that SEQ ID NO:136 (343 amino acids) has 63% identity from amino acids 1-342 with a protein from *Lactobacillus delbrueckii* that is a YgaP protein (Accession No. T09632), about 56% identity from amino acids 1-343 with a protein from *Lactobacillus johnsonii* that is a hypothetical protein LJ0871 (Accession No. NP_964726.1), about 56% identity from amino acids 1-343 with a protein from *Lactobacillus gasseri* that is a transcriptional regulator, contains sigma factor-related N-terminal domain (Accession No. ZP_00047413.1), about 40% identity from amino acids 1-342 with a protein from *Enterococcus faecalis* that is a transcriptional regulator, S or C family (Accession No. NP_815641.1), and about 59% identity from amino acids 6-88 with a protein from *Listeria monocytogenes* that is similar to *B. subtilis* CggR hypothetical transcriptional regulator (Accession No. NP_465983.1).

A Gapped BlastP amino acid sequence alignment showed that SEQ ID NO:138 (1213 amino acids) has 85% identity from amino acids 2-1212 with a protein from *Lactobacillus gasseri* that is a DNA-directed RNA polymerase, beta subunit/140 kD subunit (Accession No. ZP_00047415.1), about 56% identity from amino acids 4-1212 with a protein from *Lactobacillus johnsonii* that is a DNA-directed RNA polymerase beta chain (Accession No. NP_964352.1), about 77% identity from amino acids 2-1170 with a protein from *Lactobacillus plantarum* that is a DNA-directed RNA polymerase, beta subunit (Accession No. NP_784717.1), about 75% identity from amino acids 2-1170 with a protein from *Enterococcus faecium* that is a DNA-directed RNA polymerase beta chain (Accession No. Q8GCR4), and about 75% identity from amino acids 2-1170 with a protein from *Enterococcus faecium* that is a DNA-directed RNA polymerase beta chain (Accession No. Q8GCR6).

A Gapped BlastP amino acid sequence alignment showed that SEQ ID NO:140 (235 amino acids) has 73% identity from amino acids 1-231 with a protein from *Lactobacillus plantarum* that is a glycerol uptake facilitator protein (Accession No. NP_784003.1), about 56% identity from amino acids 1-230 with a protein from *Listeria monocytogenes* that is similar to a glycerol uptake facilitator protein (Accession No. NP_464692.1), about 55% identity from amino acids 1-230 with a protein from *Listeria innocua* that is similar to a glycerol uptake facilitator protein (Accession No. NP_470468.1), about 51% identity from amino acids 4-228 with a protein from *Listeria innocua* that is similar to a glycerol uptake facilitator (Accession No. NP_470910.1), and about 51% identity from amino acids 1-225 with a protein from *Oceanobacillus iheyensis* that is a glycerol uptake facilitator (Accession No. NP_693397.1).

A Gapped BlastP amino acid sequence alignment showed that SEQ ID NO:142 (506 amino acids) has 99% identity from amino acids 4-506 with a protein from *Lactobacillus acidophilus* that is an F1F0-ATPase subunit alpha (Accession No. AAF22496.1), about 85% identity from amino acids 1-506 with a protein from *Lactobacillus gasseri* that is an F0F1-type ATP synthase, alpha subunit (Accession No. ZP_00046243.1), about 85% identity from amino acids 4-506 with a protein from *Lactobacillus johnsonii* that is an ATP synthase alpha chain (Accession No. NP_964793.1), about 80% identity from amino acids 4-501 with a protein from *Enterococcus faecalis* that is an ATP synthase F1, alpha subunit (Accession No. NP_816249.1), and about 78% identity from amino acids 4-501 with a protein that is an ATP synthase alpha chain (Accession No. P26679).

A Gapped BlastP amino acid sequence alignment showed that SEQ ID NO:144 (288 amino acids) has about 60% identity from amino acids 2-288 with a protein from *Lactobacillus johnsonii* that is a hypothetical protein LJ0170 (Accession No. NP_964186.1), about 60% identity from amino acids 2-288 with a protein from *Lactobacillus gasseri* that is a putative glucose uptake permease (Accession No. ZP_00047239.1), about 39% identity from amino acids 2-284 with a protein from *Lactobacillus helveticus* that is a transmembrane protein (Accession No. CAA05490.1), about 37% identity from amino acids 2-287 with a protein from *Lactobacillus plantarum* that is a sugar transport protein (Accession No. NP_786013.1), and about 36% identity from amino acids 2-287 with a protein from *Listeria monocytogenes* that is similar to a glucose uptake protein (Accession No. NP_463702.1).

A Gapped BlastP amino acid sequence alignment showed that SEQ ID NO:146 (320 amino acids) has about 97% identity from amino acids 1-320 with a protein from *Lactobacillus acidophilus* that is an F1F0-ATPase subunit gamma (Accession No. AAF22497.1), about 65% identity from amino acids 1-320 with a protein from *Lactobacillus johnsonii* that is an ATP synthase gamma chain (Accession No. NP_964794.1), about 62% identity from amino acids 25-320 with a protein from *Lactobacillus gasseri* that is an FIFO-type ATP synthase, gamma subunit (Accession No. ZP_00046244.1), about 46% identity from amino acids 2-320 with a protein from *Lactobacillus plantarum* that is an ATP synthase F1 gamma subunit (Accession No. NP_816248.1), and about 46% identity from amino acids 1-320 with a protein from *Enterococcus faecium* that is an F0F1-type ATP synthase, gamma subunit (Accession No. ZP_00036478.1).

A Gapped BlastP amino acid sequence alignment showed that SEQ ID NO:148 (237 amino acids) has about 97% identity from amino acids 1-237 with a protein from *Lactobacillus acidophilus* that is an F1F0-ATPase subunit a (Accession No. AAF22492.1), about 70% identity from amino acids 2-237 with a protein from *Lactobacillus johnsonii* that is an ATP synthase A chain (Accession No. NP_964789.1), about 72% identity from amino acids 84-237 with a protein from *Lactobacillus gasseri* that is an F1F0-type ATP synthase, subunit a (Accession No. ZP_00046239.1), about 49% identity from amino acids 8-237 with a protein from *Lactobacillus plantarum* that is an H(+)-transporting two-sector ATPase, A subunit (Accession No. NP_785836.1), and about 52% identity from amino acids 7-232 with a protein from *Leuconostoc mesenteroides* that is an F0F1-type ATP synthase, subunit a (Accession No. ZP_00063080.1).

A Gapped BlastP amino acid sequence alignment showed that SEQ ID NO:150 (1217 amino acids) has about 79% identity from amino acids 1-1217 with a protein from *Lactobacillus johnsonii* that is a DNA-directed RNA polymerase beta' chain (Accession No. NP_964353.1), about 80% identity from amino acids 10-1217 with a protein from *Lactobacillus gasseri* that is a DNA-directed RNA polymerase, beta' subunit/160 kD subunit (Accession No. ZP_00047416.1), about 67% identity from amino acids 1-1217 with a protein from *Lactobacillus plantarum* that is a DNA-directed RNA polymerase, beta' subunit (Accession No. NP_784718.1), about 64% identity from amino acids 1-1214 with a protein from *Enterococcus faecium* that is a DNA-directed RNA polymerase, beta' subunit/160 kD subunit (Accession No. ZP_00037903.1), and about 64% identity from amino acids 1-1217 with a protein from *Enterococcus faecium* that is a DNA-directed RNA polymerase, beta-prime subunit (Accession No. NP_816835.1).

A Gapped BlastP amino acid sequence alignment showed that SEQ ID NO:152 (212 amino acids) has about 87% identity from amino acids 1-209 with a protein from *Lactobacillus johnsonii* that is a 50S ribosomal protein L3 (Accession No. NP_964359.1), about 87% identity from amino acids 1-209 with a protein from *Lactobacillus gasseri* that is a ribosomal protein L3 (Accession No. ZP_00047377.1), about 69% identity from amino acids 1-207 with a protein from *Enterococcus faecalis* that is a ribosomal protein L3 (Accession No. NP_814004.1), about 68% identity from amino acids 1-207 with a protein from *Lactococcus lactis* subsp. *lactis* that is a 50S ribosomal protein L3 (Accession No. NP_268256.1), and about 68% identity from amino acids 1-207 with a protein from *Lactobacillus plantarum* that is a ribosomal protein L3 (Accession No. NP_784724.1).

A Gapped BlastP amino acid sequence alignment showed that SEQ ID NO:154 (182 amino acids) has about 100% identity from amino acids 1-182 with a protein from *Lactobacillus acidophilus* that is an F1F0-ATPase subunit delta (Accession No. AAF22495.1), about 51% identity from amino acids 1-180 with a protein from *Lactobacillus johnsonii* that is an ATP synthase delta chain (Accession No. NP_964792.1), about 50% identity from amino acids 1-180 with a protein from *Lactobacillus gasseri* that is an FIFO-type ATP synthase, delta subunit (Accession No. ZP_00046242.1), about 37% identity from amino acids 3-179 with a protein from *Geobacillus stearothermophilus* that is an ATP synthase delta chain (Accession No. P42008), and about 35% identity from amino acids 1-178 with a protein that is an ATP synthase delta chain (Accession No. P26680).

A Gapped BlastP amino acid sequence alignment showed that SEQ ID NO:156 (431 amino acids) has about 83% identity from amino acids 1-431 with a protein from *Lactobacillus johnsonii* that is a preprotein translocase SecY (Accession No. NP_964379.1), about 83% identity from amino acids 1-431 with a protein from *Lactobacillus gasseri* that is a preprotein translocase subunit SecY (Accession No. ZP_00047358.1), about 61% identity from amino acids 1-431 with a protein from *Lactobacillus plantarum* that is a preprotein translocase, SecY subunit (Accession No. NP_784744.1), about 58% identity from amino acids 1-430 with a protein from *Enterococcus faecalis* that is a preprotein translocase, SecY subunit (Accession No. NP_814024.1), and about 56% identity from amino acids 1-430 with a protein from *Leuconostoc mesenteroides* that is a preprotein translocase subunit SecY (Accession No. ZP_00063524.1).

A Gapped BlastP amino acid sequence alignment showed that SEQ ID NO:158 (170 amino acids) has about 83% identity from amino acids 1-166 with a protein from *Lactobacillus johnsonii* that is a 50S ribosomal protein L10 (Accession No. NP_964440.1), about 58% identity from amino acids 1-169 with a protein from *Streptococcus mutans* that is a 50S ribosomal protein L10 (Accession No. NP_721355.1), about 58% identity from amino acids 1-166 with a protein from *Entyerococcus faecalis* that is a ribosomal protein L10 (Accession No. NP_816349.1), about 55% identity from amino acids 1-169 with a protein from *Streptococcus algalactiae* that is a ribosomal protein L10 (Accession No. NP_688300.1), and about 55% identity from amino acids 1-166 with a protein from *Streptococcus pneumoniae* that is a ribosomal protein L10 (Accession No. NP_345813.1).

A Gapped BlastP amino acid sequence alignment showed that SEQ ID NO:160 (98 amino acids) has about 77% identity from amino acids 1-98 with a protein from *Lactobacillus johnsonii* that is a 30S ribosomal protein L7 (Accession No. NP_964021.1), about 76% identity from amino acids 1-98 with a protein from *Lactobacillus gasseri* that is a ribosomal protein S6 (Accession No. ZP_00046745.1), about 59% identity from amino acids 4-97 with a protein from *Leuconostoc mesesteroides* that is a ribosomal protein S6 (Accession No. ZP_00063878.1), about 60% identity from amino acids 5-97 with a protein from *Streptococcus mutans* that is a 30S ribosomal protein S6 (Accession No. NP_722175.1), and about 56% identity from amino acids 1-95 with a protein from *Listeria monocytogenes* that is a ribosomal protein S6 (Accession No. NP_463577.1).

A Gapped BlastP amino acid sequence alignment showed that SEQ ID NO:162 (312 amino acids) has about 75% identity from amino acids 1-312 with a protein from *Lactobacillus gasseri* that is a DNA-directed RNA polymerase, alpha subunit/40 kD subunit (Accession No. ZP_00047113.1), about 75% identity from amino acids 1-312 with a protein from *Lactobacillus johnsonii* that is a DNA-directed RNA polymerase alpha chain (Accession No. NP_964385.1), about 61% identity from amino acids 1-312 with a protein from *Lactobacillus plantarum* that is a DNA-directed RNA polymerase, alpha subunit (Accession No. NP_784750.1), about 60% identity from amino acids 1-312 with a protein from *Enterococcus faecalis* that is a DNA-directed RNA polymerase, alpha subunit (Accession No. NP_814030.1), and about 57% identity from amino acids 1-312 with a protein from *Leuconostoc mesenteroides* that is a DNA-directed RNA polymerase, alpha subunit/40 kD subunit (Accession No. ZP_00063519.1).

A Gapped BlastP amino acid sequence alignment showed that SEQ ID NO:164 (180 amino acids) has about 87% identity from amino acids 1-180 with a protein from *Lactobacillus johnsonii* that is a 50S ribosomal protein L5 (Accession No. NP_964371.1), about 86% identity from amino acids 1-180 with a protein from *Lactobacillus gasseri* that is a ribosomal protein L5 (Accession No. ZP_00047365.1), about 80% identity from amino acids 1-180 with a protein from *Lactobacillus plantarum* that is a ribosomal protein L5 (Accession No. NP_784736.1), about 81% identity from amino acids 1-180 with a protein from *Leuconostoc mesenteroides* that is a ribosomal protein L5 (Accession No. ZP_00063531.1), and about 77% identity from amino acids 1-180 with a protein from *Streptococcus mutans* that is a ribosomal protein L5 (Accession No. NP_722312.1).

A Gapped BlastP amino acid sequence alignment showed that SEQ ID NO:166 (176 amino acids) has about 82% identity from amino acids 1-176 with a protein from *Lactobacillus gasseri* that is a ribosomal protein L6P/L9E (Accession No. ZP_00047363.1), about 82% identity from amino acids 1-176 with a protein from *Lactobacillus gasseri* that is a lectin-like protein LA2-20 (Accession No. BAA97125.1), about 81% identity from amino acids 1-176 with a protein from *Lactobacillus johnsonii* that is a 50S ribosomal protein L6 (Accession No. NP_964374.1), about 59% identity from amino acids 1-176 with a protein from *Enterococcus faecium* that is a ribosomal protein L6P/L6E (Accession No. ZP_00035549.1), and about 60% identity from amino acids 1-176 with a protein from *Enterococcus faecalis* that is a ribosomal protein L6 (Accession No. NP_814019.1).

A Gapped BlastP amino acid sequence alignment showed that SEQ ID NO:168 (168 amino acids) has about 76% identity from amino acids 17-168 with a protein from *Lactobacillus gasseri* that is a ribosomal protein S5 (Accession No. ZP_00047361.1), about 68% identity from amino acids 17-163 with a protein from *Bacillus stearothermophilus* that is a 30S ribosomal protein S5 (Accession No. P02357), about 67% identity from amino acids 17-163 with a protein from *Enterococcus faecalis* that is a ribosomal protein S5 (Accession No. NP_814021.1), about 66% identity from amino acids 17-163 with a protein from *Enterococcus faecium* that is a ribosomal protein L6P/L6E (Accession No. ZP_00036067.1), and about 66% identity from amino acids 17-163 with a protein from *Bacillus subtilis* that is a ribosomal protein S5 (Accession No. NP_388014.1).

A Gapped BlastP amino acid sequence alignment showed that SEQ ID NO:170 (181 amino acids) has about 87% identity from amino acids 7-181 with a protein from *Lactobacillus gasseri* that is an adenine/guanine phosphoribosyltransferase and related PRPP-binding proteins (Accession No. ZP_00046567.1), about 86% identity from amino acids 7-181 with a protein from *Lactobacillus johnsonii* that is an adenine phosphoribosyltransferase (Accession No. NP_965276.1), about 60% identity from amino acids 9-178 with a protein from *Enterococcus faecalis* that is an adenine phosphoribosyltransferase (Accession No. NP_815395.1), about 56% identity from amino acids 7-178 with a protein from *Lactobacillus plantarum* that is an adenine phosphoribosyltransferase (Accession No. NP_785602.1), and about 58% identity from amino acids 9-178 with a protein from *Staphylococcus aureus* that is an adenine phosphoribosyl transferase (Accession No. AAP15446.1).

A Gapped BlastP amino acid sequence alignment showed that SEQ ID NO:172 (334 amino acids) has about 100% identity from amino acids 1-334 with a protein from *Lactobacillus acidophilus* that is a transcriptional repressor MsmR (Accession No. AAO21855.1), about 48% identity from amino acids 4-334 with a protein from *Streptococcus pneumoniae* that is a sucrose operon repressor (Accession NP_359213.1), about 46% identity from amino acids 4-334 with a protein from *Streptococcus pneumoniae* that is a LacI family sugar-binding transcriptional regulator (Accession No. NP_346232.1), about 37% identity from amino acids 10-333 with a protein from *Lactobacillus johnsonii* that is a hypothetical protein LJ0744 (Accession No. NP_964596.1), and about 36% identity from amino acids 10-334 with a protein from *Lactobacillus gasseri* that is a transcriptional regulator (Accession No. ZP_00047431.1).

EXAMPLE 14

PFAM Results for Amino Acid Sequences

SEQ ID NO:2 contains a predicted SBP_bac_1 domain located from about amino acids 28 to 403, and is a member of the Bacterial extracellular solute-binding protein family (SBP_bac_1) (SBP_bacterial_1) (PFAM Accession PF01547).

SEQ ID NO:4 contains a predicted BPD_transp_1 domain located from about amino acids 179 to 256, and is a member of the Binding-protein-dependent transport system inner membrane component family (BPD_transp_1) (BPD_transp) (PFAM Accession PF00528).

SEQ ID NO:6 contains a predicted BPD_transp_1 domain located from about amino acids 168 to 244, and is a member of the Binding-protein-dependent transport system inner membrane component family (BPD_transp_1) (BPD_transp) (PFAM Accession PF00528).

SEQ ID NO:8 contains a predicted Glyco_hydro_32 domain located from about amino acids 24 to 409, and is a member of the Glycosyl hydrolases family 32 family (Glyco_hydro_32) (PFAM Accession PF00251).

SEQ ID NO:10 contains a predicted ABC_tran domain located from about amino acids 31 to 212, and is a member of the ABC transporter family (ABC_tran) (PFAM Accession PF00005).

SEQ ID NO:14 contains a predicted GARS_N domain located from about amino acids 9 to 109, a predicted GARS_B domain located from about amino acids 111 to 186, a predicted GARS domain located from about amino acids 189 to 328, a predicted GARS_C domain located from about amino acids 330 to 422, and is a member of the Phosphoribosylglycinamide synthetase, ATP-grasp (A) domain family (GARS_A) (GARS) (PFAM Accession PF01071), a member of the Phosphoribosylglycinamide synthetase, N domain family (GARS_N) (PFAM Accession PF02844), a member of the Phosphoribosylglycinamide synthetase, B domain family (GARS_B) (PFAM Accession PF02842) and a member of the Phosphoribosylglycinamide synthetase, C domain family (GARS_C) (PFAM Accession PF02843).

SEQ ID NO:16 contains a predicted MGS domain located from about amino acids 4 to 128, a predicted AICARFT_IMPCHas domain located from about amino acids 133 to 447, and is a member of the AICARFT/IMPCHase bienzyme family (AICARFT_IMPCHas) (PFAM Accession PF01808), and a member of the MGS-like domain family (MGS) (PFAM Accession PF02142).

SEQ ID NO:18 contains a predicted formyl_transf_N domain located from about amino acids 1 to 185, and is a member of the Formyl transferase family (formyl_transf_N) (PFAM Accession PF00551).

SEQ ID NO:20 contains a predicted AIRS domain located from about amino acids 1 to 161, a predicted AIRS_C domain located from about amino acids 171 to 343, and is a member of the AIR synthase related protein, N-terminal domain family (AIRS) (PFAM Accession PF00586), and a member of the AIR synthase related protein, C-terminal domain family (AIRS_C) (PFAM Accession PF02769).

SEQ ID NO:22 contains a predicted GATase_2 domain located from about amino acids 18 to 200, a predicted Pribosyltran domain located from about amino acids 258 to 415, and is a member of the Glutamine amidotransferases class-II family (GATase 2) (PFAM Accession PF00310), and a member of the Phosphoribosyl transferase domain family (Pribosyltran) (PFAM Accession PF00156).

SEQ ID NO:24 contains a predicted AIRS domain located from about amino acids 45 to 195 and from about amino acids 408-565, a predicted AIRS_C domain located from about amino acids 206 to 364 and about amino acids 576 to 715, and is a member of the AIR synthase related protein, N-terminal domain family (AIRS) (PFAM Accession PF00586), and a member of the AIR synthase related protein, C-terminal domain family (AIRS_C) (PFAM Accession PF02769).

SEQ ID NO:28 contains a predicted PurC domain located from about amino acids 3 to 81, and is a member of the Phosphoribosylformylglycinamidine (FGAM) synthase family (PurC) (PFAM Accession PF02700).

SEQ ID NO:30 contains a predicted SAICAR_synt domain located from about amino acids 1 to 235, and is a member of the SAICAR synthetase family (SAICAR_synt) (PFAM Accession PF01259).

SEQ ID NO:32 contains a predicted PTS_EIIB domain located from about amino acids 7 to 40, a predicted PTS_EIIC domain located from about amino acids 110 to 404, a predicted PTS_EIIA__1 domain located from about amino acids 517 to 621, and is a member of the Phosphotransferase system, EIIC family (PTS_EIIC) (PFAM Accession PF02378), a member of the phosphoenolpyruvate-dependent sugar phosphotransferase system, EIIA 1 family (PTS_EIIA__1) (PFAM Accession PF00358), and a member of the phosphotransferase system, EIIB family (PTS_EIIB) (PFAM Accession PF00367).

SEQ ID NO:36 contains a predicted MIP domain located from about amino acids 1 to 244, and is a member of the Major intrinsic protein family (MIP) (PFAM Accession PF00230).

SEQ ID NO:42 contains a predicted ABC_tran domain located from about amino acids 33 to 227, and is a member of the ABC transporter family (ABC_tran) (PFAM Accession PF00005).

SEQ ID NO:44 contains a predicted BPD_transp_1 domain located from about amino acids 161 to 237, and is a member of the Binding-protein-dependent transport system inner membrane component family (BPD_transp__1) (PFAM Accession PF00528).

SEQ ID NO:48 contains a predicted xan_ur_permease domain located from about amino acids 18 to 397, and is a member of the Permease family (xan_ur_permease) (PFAM Accession PF00860).

SEQ ID NO:50 contains a predicted PTS_EIIA__1 domain located from about amino acids 49 to 153, a predicted PTS_EIIB domain located from about amino acids 197 to 231, a predicted PTS_EIIC domain located from about amino acids 301 to 587, and is a member of the phosphoenolpyruvate-dependent sugar phosphotransferase system, EIIA 1 family (PTS_EIIA__1) (PFAM Accession PF00358), a member of the Phosphotransferase system, EIIC family (PTS_EIIC) (PFAM Accession PF02378), and a member of the phosphotransferase system, EIIB family (PTS_EIIB) (PFAM Accession PF00367).

SEQ ID NO:52 contains a predicted gntR domain located from about amino acids 9 to 68, and is a member of the Bacterial regulatory proteins, gntR family (GntR) (PFAM Accession PF00392).

SEQ ID NO:54 contains a predicted alpha-amylase domain located from about amino acids 28 to 429, and is a member of the Alpha amylase, catalytic domain family (alpha-amylase) (PFAM Accession PF00128).

SEQ ID NO:60 contains a predicted SBP_bac__1 domain located from about amino acids 51 to 420, and is a member of the Bacterial extracellular solute-binding protein family (SBP_bac__1) (PFAM Accession PF01547).

SEQ ID NO:62 contains a predicted Ribosomal_S12 domain located from about amino acids 1 to 135, and is a member of the Ribosomal protein S12 family (Ribosomal_S12) (PFAM Accession PF00164).

SEQ ID NO:66 contains a predicted Enolase_C domain located from about amino acids 10 to 427, and is a member of the Enolase, C-terminal TIM barrel domain family (Enolase_C) (PFAM Accession PF00113).

SEQ ID NO:68 contains a predicted GTP_EFTU domain located from about amino acids 20 to 214, a predicted GTP_EFTU_D2 domain located from about amino acids 226 to 305, a predicted GTP_EFTU_D3 domain located from about amino acids 309 to 404, and is a member of the Elongation factor Tu GTP binding domain family (GTP_EFTU) (PFAM Accession PF00009), a member of the Elongation factor Tu C-terminal domain family (GTP_EFTU_D3) (PFAM Accession PF03143), and a member of the Elongation factor Tu domain 2 family (GTP_EFTU_D2) (PFAM Accession PF03144).

SEQ ID NO:70 contains a predicted PK domain located from about amino acids 1 to 346, a predicted PK_C domain located from about amino acids 360 to 475, a predicted PEP-utilizers domain from about amino acids 490-579, and is a member of the Pyruvate kinase barrel domain family (PK) (PFAM Accession PF00224), a member of the Pyruvate kinase alpha/beta domain family (PK_C) (PFAM Accession PF02887), and a member of the PEP-utilizing enzyme mobile domain family (PEP-utilizers) (PFAM Accession PF00391).

SEQ ID NO:72 contains a predicted PTS_EIIA__2 domain located from about amino acids 5-149, a predicted PTS_IIB_fruc domain located from about amino acids 183-285, a predicted PTS_EIIC domain from about amino acids 315-597, and is a member of the Phosphoenolpyruvate-dependent sugar phosphotransferase system, EIIA 2 family (PTS_EIIA__2) (PFAM Accession PF00359), a member of the PTS system, Fructose specific IIB subunit family (PTS_IIB_fruc) (PFAM Accession PF02379), and a member of the Phosphotransferase system EIIC family (PTS_EIIC) (PFAM Accession PF02378).

SEQ ID NO:74 contains a predicted PfkB domain located from about amino acids 5-292, and is a member of the PfkB family carbohydrate kinase family (PfkB) (PFAM Accession PF00294).

SEQ ID NO:76 contains a predicted Ldh domain from about amino acids 5-147, a predicted Ldh_C domain from about amino acids 149-317, and is a member of the lactate/malate dehydrogenase, NAD binding domain family (Ldh__1_N) (PFAM Accession PF00056), and a member of the lactate/malate dehydrogenase, alpha/beta C-terminal domain family (Ldh__1_C) (PFAM Accession 02866).

SEQ ID NO:78 contains a predicted SAICAR_synt domain from about amino acids 1-235, and is a member of the SAICAR synthase family (SAICAR_synt) (PFAM Accession 01259).

SEQ ID NO:80 contains a predicted DeoR domain from about amino acids 6-231, and is a member of the Bacterial regulatory proteins, deoR family (DeoR) (PFAM Accession 00455).

SEQ ID NO:82 contains a predicted Ribosomal_L1 domain from about amino acids 33-239, and is a member of the Ribosomal protein L1p/L10e family (Ribosomal_L1) (PFAM Accession PF00687).

SEQ ID NO:84 contains a predicted 2-Hacid_DH domain from about amino acids 15-113, and a predicted 2-Hacid_DH_C domain from about amino acids 115-309, and is a member of the D-isomer specific 2-hydroxyacid dehydrogenase, catalytic domain family (2-Hacid_DH) (PFAM Accession PF00389), and a member of the D-isomer specific 2-hydroxyacid dehydrogenase, NAD binding domain family (2-Hacid_DH_C) (PFAM Accession PF02826).

SEQ ID NO:86 contains a predicted SLAP domain from about amino acids 1-456, and is a member of the Bacterial surface layer protein family (SLAP) (PFAM Accession PF03217).

SEQ ID NO:88 contains a predicted PEP-utilizers domain from about amino acids 146-227, a predicted PEP-utilizers_C domain from about amino acids 252-546, and is a member of the PEP-utilizing enzyme, mobile domain family (PEP-utilizers) (PFAM Accession PF00391), and a member of the PEP-utilizing enzyme, TIM barrel domain family (PEP-utilizers_C) (PFAM Accession PF02896).

SEQ ID NO:90 contains a predicted PGAM domain from about amino acids 2-226, and is a member of the Phosphoglycerate mutase family (PGAM) (PFAM Accession PF00300)

SEQ ID NO:92 contains a predicted PFK domain from about amino acids 1-234, and is a member of the Phosphofructokinase family (PFK) (PFAM Accession PF00365)

SEQ ID NO:96 contains a predicted GTP_EFTU domain from about amino acids 10-218, a predicted GTP_EFTU_D2 domain from about amino acids 313-392, a predicted EFG_C domain from about amino acids 513-684, and is a member of the Elongation factor Tu GTP binding domain family (GTP_EFTU) (PFAM Accession PF00009), a member of the Elongation factor Tu domain 2 family (GTP_EFTU_D2) (PFAM Accession PF03144), and a member of the Elongation factor G C-terminus family (EFG_C) (PFAM Accession PF00679).

SEQ ID NO:98 contains a predicted Peptidase_M3 domain from about amino acids 9-278, and is a member of the Peptidase family M3 (Peptidase_M3) (PFAM Accession PF01432).

SEQ ID NO:100 contains a predicted Ribosomal_S9 domain from about amino acids 11-131, and is a member of the Ribosomal protein S9/S16 family (Ribosomal_S9) (PFAM Accession PF00380).

SEQ ID NO:102 contains a predicted Gp_dh_N domain from about amino acids 2-256, a predicted Gp_dh_C domain from about amino acids 157-318, and is a member of the Glyceraldehyde 3-phosphate dehydrogenase, NAD binding domain family (Gp_dh_N) (PFAM Accession PF00044), and a member of the Glyceraldehyde 3-phosphate dehydrogenase, C-terminal domain family (Gp_dh_C) (PFAM Accession PF02800).

SEQ ID NO:106 contains a predicted ATP-synt_ab_N from about amino acids 6-75, a predicted ATP-synt_ab domain from about amino acids 78-352, a predicted ATP-synt_ab_C domain from about amino acids 355-466, and is a member of the ATP synthase alpha/beta, beta-barrel domain family (ATP-synt_ab_N) (PFAM Accession PF02874), a member of the ATP synthase alpha/beta, nucleotide-binding domain family (ATP-synt_ab) (PFAM Accession PF0006), and a member of the ATP synthase alpha/beta, C-terminal domain family (ATP-synt_ab_C) (PFAM Accession PF00306).

SEQ ID NO:108 contains a predicted Ribosomal_S3_N domain from about amino acids 1-61, a predicted KH_1 domain from about amino acids 64-111, a predicted Ribosomal_S3_C domain from about amino acids 118-201, and is a member of the Ribosomal protein S3, C-terminal domain family (Ribosomal_S3_N) (PFAM Accession PF00417), a member of the KH domain family (KH_1) (PFAM Accession PF00013), and a member of the Ribosomal protein S3, N-terminal domain family (Ribosomal_S3_C) (PFAM Accession PF00189).

SEQ ID NO:110 contains a predicted Xan_ur_permease domain from about amino acids 30-409, and is a member of the Permease family (Xan_ur_permease) (PFAM Accession PF00860).

SEQ ID NO:112 contains a predicted S1 RNA binding domain from about amino acids 108-177, and is a member of the S1 RNA binding domain family (S1) (PFAM PF00575).

SEQ ID NO:114 contains a predicted PGK domain from about amino acids 4-408, and is a member of the Phosphoglycerate kinase family (PGK) (PFAM Accession PF00162).

SEQ ID NO:116 contains a predicted Ribosomal_S4 domain from about amino acids 33-124, a predicted S4 domain from about amino acids 125-172, and is a member of the Ribosomal protein S4/S9 N-terminal domain family (Ribosomal_S4) (PFAM Accession PF00163), and a member of the S4 domain family (S4) (PFAM Accession PF01479).

SEQ ID NO:118 contains a predicted Ribosomal_L31 domain from about amino acids 1-80, and is a member of the Ribosomal protein L31 family (Ribosomal_L31) (PFAM Accession PF01197)

SEQ ID NO:120 contains a predicted Ribosomal_S7 domain from about amino acids 1-156, and is a member of the Ribosomal protein S7p/S7e family (Ribosomal_S7) (PFAM Accession PF00177).

SEQ ID NO:122 contains a predicted Ribosomal_L21p domain from about amino acids 1-96, and is a member of the Ribosomal prokaryotic L21 protein family (Ribosomal_L21p) (PFAM Accession PF00829).

SEQ ID NO:124 contains a predicted Pribosyltran domain from about amino acids 138-275, and is a member of the Phosphoribosyl transferase domain family (Pribosyltran) (PFAM Accession PF00156).

SEQ ID NO:126 contains a predicted SSB domain from about amino acids 6-108, and is a member of the Single-strand binding protein family (SSB) (PFAM Accession PF00436).

SEQ ID NO:128 contains a predicted PGI domain from about amino acids 7-442, and is a member of the Phosphoglucose isomerase family (PGI) (PFAM Accession PF00342).

SEQ ID NO:130 contains a predicted TPP_enzyme N domain from about amino acids 2-174, a predicted TPP_enzyme_M domain from about amino acids 190-340, a predicted TPP_enzyme_C domain from about aminoacids 357-530, and is a member of the Thiamine pyrophosphate enzyme, N-terminal TPP binding domain family (TPP_enzyme N) (PFAM Accession PF02776), a member of the Thiamine pyrophosphate enzyme, central domain family (TPP_enzyme_M) (PFAM Accession PF00205), and a member of the Thiamine pyrophosphate enzyme, C-terminal TPP binding domain family (TPP_enzyme_C) (PFAM Accession PF02775).

SEQ ID NO:132 contains a predicted SBP_bac_5 domain from about amino acids 12-583, and is a member of the Bacterial extracellular solute-binding proteins, family 5 middle family (SBP_bac_5) (PFAM Accession PF00496).

SEQ ID NO:134 contains a predicted Ribosomal_S20p domain from about amino acids 7-90, and is a member of the Ribosomal protein S20 family (Ribosomal_S20p) (PFAM Accession PF01649).

SEQ ID NO:140 contains a predicted MIP domain from about amino acids 1-231, and is a member of the Major intrinsic protein family (MIP) (PFAM Accession PF00230).

SEQ ID NO:142 contains a predicted ATP-synt_ab_N domain from about amino acids 27-95, a predicted ATP-synt_ab domain from about amino acids 98-373, a predicted ATP-synt_ab_C domain from about amino acids 375-473, and is a member of the ATP synthase alpha/beta, beta-barrel domain family (ATP-synt_ab_N) (PFAM Accession PF02874), a member of the ATP synthase alpha/beta, nucleotide-binding domain family (ATP-synt_ab) (PFAM Accession PF0006), and a member of the ATP synthase alpha/beta, C-terminal domain family (ATP-synt_ab_C) (PFAM Accession PF00306).

SEQ ID NO:146 contains a predicted ATP-synt domain from about amino acids 3-319, and is a member of the ATP synthase family (ATP-synt) (PFAM Accession PF00231).

SEQ ID NO:148 contains a predicted ATP-synt A domain from about amino acids 72-232, and is a member of the ATP synthase A chain family (ATP-synt A) (PFAM Accession PF00119).

SEQ ID NO:150 contains a predicted RNA_pol_A domain from about amino acids 224-838, a predicted RNA_pol_A2 domain from about amino acids 893-1184, and is a member of the RNA polymerase alpha subunit family (RNA_pol_A), and a member of the RNA polymerase A/beta'/A" subunit family.

SEQ ID NO:152 contains a predicted Ribosomal_L3 domain from about amino acids 9-202, and is a member of the Ribosomal protein L3 family (Ribosomal_L3) (PFAM Accession PF00297).

SEQ ID NO:154 contains a predicted OSCP domain from about amino acids 8-178, and is a member of the ATP synthase delta (OSCP) subunit family (OSCP) (PFAM Accession PF00213).

SEQ ID NO:156 contains a predicted SecY domain from about amino acids 68-416, and is a member of the eubacterial secY protein family (SecY) (PFAM Accession PF00344)

SEQ ID NO:158 contains a predicted Ribosomal_L10 domain from about amino acids 4-104, and is a member of the Ribosomal L10 protein family (Ribosomal_L10) (PFAM Accession PF00466).

SEQ ID NO:160 contains a predicted Ribosomal_S6 domain from about amino acids 4-96, and is a member of the Ribosomal protein S6 family (PFAM Accession PF01250).

SEQ ID NO:162 contains a predicted RNA_pol_A_bac domain from about amino acids 18-219, a predicted RNA_pol_A_CTD domain from about amino acids 236-303, and is a member of the RNA polymeraseRbp3/RpoA insert domain (RNA_pol_A_bac) (PFAM Accession PF01000), and a member of the Bacterial RNA polymerase, alpha chain C terminal domain family (RNA_pol_A_CTD) (PFAM Accession PF03118).

SEQ ID NO:164 contains a predicted Ribosomal_L5 domain from about amino acids 25-81, a predicted Ribosomal_L5_C domain from about amino acids 85-179, and is a member of the Ribosomal protein L5 family (Ribosomal_L5) (PFAM Accession PF00281), and a member of the Ribosomal L5P family C-terminus family (Ribosomal_L5_C) (PFAM Accession PF00673).

SEQ ID NO:166 contains a predicted Ribosomal_L6 domain from about amino acids 11-176, and is a member of the Ribosomal protein L6 family (Ribosomal_L6) (PFAM Accession PF00347).

SEQ ID NO:168 contains a predicted Ribosomal_S5 domain from about amino acids 21-149, and is a member of the Ribosomal protein S5, N-terminal domain family (Ribosomal_S5) (PFAM Accession PF00333).

SEQ ID NO:170 contains a predicted Pribosyltran domain from about amino acids 26-179, and is a member of the Phosphoribosyl transferase domain family (Pribosyltran) (PFAM Accession PF00156).

SEQ ID NO:172 contains a predicted LacI domain from about amino acids 9-36, a predicted Peripla_BP_1 domain from about amino acids 68-331, and is a member of the Bacterial regulatory proteins, lacI family (LacI) (PFAM Accession PF00356), and a member of the Periplasmic binding proteins and sugar binding domain of the LacI family (Peripla_BP_1) (PFAM Accession PF00532)

REFERENCES

1. Ajdic, D., McShan, W. M., McLaughlin, R. E., Savic, G., Chang, J., Carson, M. B., Primeaux, C., Tian, R., Kenton, S., Jia, H., Lin, S., Qian, Y., Li, S., Zhu, H., Najar, F., Lai, H., White, J., Roe, B. A. & Ferretti, J. J. (2002) *Proc. Natl. Acad. Sci. USA* 99, 14434-14439.
2. Kleerebezem, M., Boekhorst, J., van Kranenburg, R., Molenaar, D., Kuipers, O. P., Leer, R., Tarchini, R., Peters, S. A., Sandbrink, H. M., Fiers, M. W., Stiekema, W., Lankhorst, R. M., Bron, P. A., Hoffer, S. M., Groot, M. N., Kerkhoven, R., de Vries, M., Ursing, B., de Vos, W. M. & Siezen, R. J. (2003) *Proc. Natl. Acad. Sci. USA* 100, 1990-5.
3. Schell, M. A., Karmirantzou, M., Snel, B., Vilanova, D., Berger, B., Pessi, G., Zwahlen, M. C., Desiere, F., Bork, P., Delley, M., Pridmore, R. D. & Arigoni, F. (2002) *Proc. Natl. Acad. Sci. USA* 99, 14422-14427.
4. Gibson, G. R. & Roberfroid, M. B. (1995) *J. Nutr.* 125, 1401-1412.
5. Moshfegh, A. J., Friday, J. E., Goldman, J. P. & Ahuja, J. K. C. (1999) *J. Nutr.* 129, 1407s-1411s.
6. Kaplan, H. & Hutkins, R. W. (2000) *Appl. Environ. Microbiol.* 66, 2682-2684.
7. Hartemink, R., Quataert, M. C. J., Vanlaere, K. M. J., Nout, M. J. R. & Rombouts, F. M. (1995) *J. Appl. Bacteriol.* 79, 551-557.
8. Hartemink, R., VanLaere, K. M. J. & Rombouts, F. M. (1997) *J. Appl. Microbiol.* 83, 367-374.
9. Van Laere, K. M., Hartemink, R., Bosveld, M., Schols, H. A. & Voragen, A. G. (2000) *J. Agric. Food Chem.* 48, 1644-52.
10. Orrhage, K., Sjostedt, S. & Nord, C. E. (2000) *J. Antimicrob. Chemother.* 46, 603-12.
11. Rycroft, C. E., Jones, M. R., Gibson, G. R. & Rastall, R. A. (2001) *J. Appl. Microbiol.* 91, 878-87.
12. Barefoot, S. F. & Klaenhammer, T. R. (1983) *Appl. Environ. Microbiol.* 45, 1808-15.
13. Salzberg, S. L., Delcher, A. L., Kasif, S. & White, O. (1998) *Nucleic Acids Res.* 26, 544-8.
14. Delcher, A. L., Harmon, D., Kasif, S., White, O. & Salzberg, S. L. (1999) *Nucleic Acids Res.* 27, 4636-41.
15. Altschul, S. F., Gish, W., Miller, W., Myers, E. W. & Lipman, D. J. (1990) *J. Mol. Biol.* 215, 403-10.
16. Thompson, J. D., Higgins, D. G. & Gibson, T. J. (1994) *Nucleic Acids Res.* 22, 4673-4680.
17. Kumar, S., Tamura, K., Jakobsen, I. B. & Nei, M. (2001) *Bioinformatics* 17, 1244-5.
18. Russell, W. M. & Klaenhammer, T. R. (2001) *Appl. Environ. Microbiol.* 67, 4361-4.
19. Law, J., Buist, G., Haandrikman, A., Kok, J., Venema, G. & Leenhouts, K. (1995) *J. Bacteriol.* 177, 7011-8.
20. Russell, R. R. B., Aduseopoku, J., Sutcliffe, I. C., Tao, L. & Ferretti, J. J. (1992) *J. Biol. Chem.* 267, 4631-4637.
21. Quentin, Y., Fichant, G. & Denizot, F. (1999) *J. Mol. Biol.* 287, 467-84.
22. Krogh, A., Larsson, B., von Heijne, G. & Sonnhammer, E. L. (2001) *J. Mol. Biol.* 305, 567-80.
23. Braibant, M., Gilot, P. & Content, J. (2000) *FEMS Microbiol. Rev.* 24, 449-67.
24. Linton, K. J. & Higgins, C. F. (1998) *Mol. Microbiol.* 28, 5-13.
25. McLaughlin, R. E. & Ferretti, J. J. (1996) *Fems Microbiol. Lett.* 140, 261-264.
26. Nguyen, C. C. & Saier, M. H., Jr. (1995) *FEBS Lett.* 377, 98-102.

27. Yamamoto, H., Serizawa, M., Thompson, J. & Sekiguchi, J. (2001) *J. Bacteriol.* 183, 5110-21.
28. Miwa, Y., Nakata, A., Ogiwara, A., Yamamoto, M. & Fujita, Y. (2000) *Nucleic Acids Res.* 28, 1206-10.
29. Weickert, M. J. & Chambliss, G. H. (1990) *Proc. Natl. Acad. Sci. USA* 87, 6238-42.
30. Burne, R. A., Wen, Z. T., Chen, Y. Y. M. & Penders, J. E. C. (1999) *J. Bacteriol.* 181, 2863-2871.
31. Hueck, C. J., Hillen, W. & Saier, M. H., Jr. (1994) *Res. Microbiol.* 145, 503-18.
32. Wen, Z. T. & Burne, R. A. (2002) *J. Bacteriol.* 184, 126-33.
33. Liebl, W., Brem, D. & Gotschlich, A. (1998) *Appl. Microbiol. Biotechnol.* 50, 55-64.
34. Burne, R. A., Schilling, K., Bowen, W. H. & Yasbin, R. E. (1987) *J. Bacteriol.* 169, 4507-4517.
35. Onodera, S. & Shiomi, N. (1988) *Agric. Biol. Chem.* 52, 2569-2576.
36. Xiao, R., Tanida, M. & Takao, S. (1989) *J. Ferment. Bioeng.* 67, 331-334.
37. Mckellar, R. C. & Modler, H. W. (1989) *Appl. Microbiol. Biotechnol.* 31, 537-541.
38. Menendez, C., Hernandez, L., Selman, G., Mendoza, M. F., Hevia, P., Sotolongo, M. & Arrieta, J. G. (2002) *Curr. Microbiol.* 45, 5-12.
39. Oda, Y. & Ito, M. (2000) *Curr. Microbiol.* 41, 392-5.
40. Perrin, S., Grill, J. P. & Schneider, F. (2000) *J. Appl. Microbiol.* 88, 968-74.
41. Muramatsu, K., Onodera, S., Kikuchi, M. & Shiomi, N. (1992) *Biosci. Biotech. Biochem.* 56, 1451-1454.
42. Saito, K., Kondo, K., Kojima, I., Yokota, A. & Tomita, F. (2000) *Appl. Environ. Microbiol.* 66, 252-6.
43. Song, E. K., Kim, H., Sung, H. K. & Cha, J. (2002) *Gene* 291, 45-55.
44. Naumoff, D. G. (2001) *Proteins* 42, 66-76.
45. Reddy, V. A. & Maley, F. (1990) *J. Biol. Chem.* 265, 10817-20.
46. Burne, R. A. & Penders, J. E. (1992) *Infect. Immun.* 60, 4621-32.
47. Lambert, A., Osteras, M., Mandon, K., Poggi, M. C. & Le Rudulier, D. (2001) *J. Bacteriol.* 183, 4709-4717.
48. Hiratsuka, K., Wang, B., Sato, Y. & Kuramitsu, H. (1998) *Infect. Immun.* 66, 3736-43.
49. Luesink, E. J., Marugg, J. D., Kuipers, O. P. & de Vos, W. M. (1999) *J. Bacteriol.* 181, 1924-6.
50. Kaplan, H., and Hutkins, R. W. (2003) *Appl. Environ. Microbiol.*, 69, 2217-2222.
51. Koonin, E. V., Makarova, K. S. & Aravind, L. (2001) *Annu. Rev. Microbiol.* 55, 709-742.
52. Salama, N., Guillemin, K., McDaniel, T. K., Sherlock, G., Tompkins, L. & Falkow, S. (2000) *Proc. Natl. Acad. Sci. USA* 97, 14668-73.
53. Dorrell, N., Mangan, J. A., Laing, K. G., Hinds, J., Linton, D., Al-Ghusein, H., Barrell, B. G., Parkhill, J., Stoker, N. G., Karlyshev, A. V., Butcher, P. D. & Wren, B. W. (2001) *Genome Res.* 11, 1706-15.
54. Hakenbeck, R., Balmelle, N., Weber, B., Gardes, C., Keck, W. & de Saizieu, A. (2001) *Infect. Immun.* 69, 2477-86.
55. Nesbo, C. L., Nelson, K. E. & Doolittle, W. F. (2002) *J. Bacteriol.* 184, 4475-88.

TABLE 2

Cre sequences

| Bacterium | Sequence* | Origin |
|---|---|---|
| B. subtilis | WTGNAANCGNWNNCW (SEQ ID NO: 176) | (28) search sequence |
| B. subtilis | WWTGNAARCGNWWWCAWW (SEQ ID NO: 177) | (28) new consensus |
| B. subtilis | TGWAANCGNTNWCA (SEQ ID NO: 178) | (29) consensus |
| B. subtilis | TGTAAGCGCTTACA (SEQ ID NO: 179) | (29) optimal operator |
| B. subtilis | TGTAAACGTTATCA (SEQ ID NO: 180) | (27) |
| L. acidophilus cre1 | ATTG-AAACGTTT-CAA (SEQ ID NO: 181) | upstream of msmE |
| L. acidophilus cre2 | ATAG-AAACGTTT-CAA (SEQ ID NO: 182) | upstream of msmE |
| S. pneumoniae cre1 | AATG-AAACGTTT-CAA (SEQ ID NO: 183) | upstream of msmE2 |
| S. pneumoniae cre2 | AATG-AAACGTTT-CAA (SEQ ID NO: 184) | upstream of msmE2 |
| L. acidophilus scr | AATAAAAGCGTTTACAT (SEQ ID NO: 185) | upstream of scrB |
| L. acidophilus cre3 | TATGAAAGCGCTTAAAA (SEQ ID NO: 186) | upstream of msmE2 |
| S. mutans creW | AGATAGCGATTTGG (SEQ ID NO: 187) | (30) |
| S. mutans creS | AGATAGCGCTTACA (SEQ ID NO: 188) | (30) |

*N, any; W, A or T; R, G or A; shaded nucleotides were specifically conserved and consistent with the consensus sequences.

TABLE 3

Primers used in this study.

| Primer | Sequence* | Gene† | Position‡ |
|---|---|---|---|
| A | GTAATAATAGTCAAAGTGGC (SEQ ID NO: 189) | msmEf | 1,518 |
| B | GATCGGATCCAAGATCAATGCTGCTTTAAA (SEQ ID NO: 190) | msmEf₂ | 1,706 |
| C | GGAAGGCTGAAGTAGTTTGC (SEQ ID NO: 191) | msmEr | 2,192 |
| D | GATCGAATTCGATACAGGATATGGCATTACG (SEQ ID NO: 192) | msmEr₂ | 2,355 |
| F | AGGATCCATCCATATGCTCCACACT (SEQ ID NO: 193) | bfrAf | 4,655 |
| F | AGAATTCAACATGATCAGCACTTCT (SEQ ID NO: 194) | bfrAr | 5,370 |
| G | GGAATATCTTCGGCTAATTG (SEQ ID NO: 195) | bfrAr₂ | 5,540 |
| H | CCACTTCAAGTAGCTGTTACTAATA (SEQ ID NO: 196) | msmGf | 4,337 |

TABLE 3-continued

Primers used in this study.

| Primer | Sequence* | Gene† | Position‡ |
|---|---|---|---|
| I | CTTGAGTAAGATACTTT TGG (SEQ ID NO: 197) | msmGr | 4,469 |
| J | GACCAGAAGATATTCAC GCC (SEQ ID NO: 198) | msmKf | 6,661 |
| K | ACCTGGCTTGTGATAAT CAC (SEQ ID NO: 199) | msmKr | 6,833 |
| L | GGTCTTTGAACTTGTTC CGC (SEQ ID NO: 200) | gtfAr | 8,269 |

*underlined sequence indicates restriction site used for cloning.
†f, indicates forward strand; r, indicates reverse strand.
‡position of the 5' end of the primer, relative to the 10,000 bp DNA locus.

TABLE 4

Genes and proteins used for comparative genomic analyses

| Bacterium | Genome or locus | Sequence information |
|---|---|---|
| B. anthracis | NC_003995 | bfrA NP_654697 |
| B. halodurans | NC_002570 | BH1855 NP_242721, SacP NP242722, BH1857 NP_242723, SacA NP_242724, 16S (nt22,819-24,370), MsmR NP_243093, MsmE NP_243092, AmyD NP_243091, AmyC NP_243090, bh2223 NP_243089 |
| B. longum | AE014295 | cscA BL0105 (fructosidase) AE014625_3, cscB (major facilitator family permease) AE014625_4, BL0107 (lacI) AE014625_5, 16S nt AE014785 nt 2,881-4,400 |
| B. subtilis | NC_000964 | SacT NP_391686, SacP NP_391684. SacA NP_391683, 16S nt 9,809-11,361, MsmR NP_390904, MsmE NP_390905, AmyD NP_390906, AmyC NP_390907, MelA NP_390908, SacC NP_390581, YdhR O05510, YdjE O34768 |
| C. acetobutylicum | NC_003030 | LicT NP_347062, 0423 NP_347063, 0424 NP_347064, SacA NP_347066, 16S nt 9,710-11,219 |
| C. beijerinckii | AF059741 | ScrA AAC99320, ScrR AAC999321, ScrB AAC99322, ScrK AAC99323, 16S X_68179 |
| C. perfringens | NC_003366 | 1531 NP_562447, SacA NP_562448, 1533 NP_562449, 1534 NP_562450, 16S 10,173-11,680 |
| E. coli | NC_002655 | 3623 NP_288931, 3624 NP_288932, 3625 NP_288933, 3626 NP_288934, 16S nt 227,103-228,644 |
| E. faecalis | TIGR shotgun, NC 002938 | EF1601, EF1603, EF1604, 16S AF515223, EFA0067, EFA0069, EFA0070, available at the website at tigr.org |
| G. stearothermophilus | TIGR shotgun, NC_002926 | 16S contig221 nt 1,001-2,440, SurT AAB38977, SurP AAB72022, SurA AAB38976, PfK KIBSFF |
| K. pneumoniae | WashU shotgun, NC_002941 | ScrR P37076, ScrA CAA40658, ScrB CAA40659, 16S AJ233420, locus X57401 |
| L. acidophilus | AY172019 (msm), AY172020 (msm2), AY177419 (scr) | ScrR, ScrB, ScrA, 16S nt 59,261-60,816, MsmR, MsmE, MsmF, MsmG, BfrA, MsmK, GtfA, MsmR2, MsmE2, MsmF2, MsmG2, MsmK2, Aga, GtfA2 |
| L. fermentum | | ScrK CAD24410 |
| L. gasseri | NZ_AAAB01000011 In progress, JGI | ScrR ZP_00046868, ScrB58 (contig 58) ZP_00046078, ScrB38 (contig 38) ZP_00046869, ScrA21 (contig 21), ScrA 58 (contig 58) ZP_00046080, ScrK ZP_00046753, 16S AF519171 |
| L. lactis | M96669 | SacB CAB09690, SacA CAB09689, SacR CAB09692, SacK CAB09691, Luesink et al., 1999, 16S X54260 |
| L. plantarum | AL935263 | 16S AF515222, sacK1 CAD62854, pts1bca CAD62855, sacA CAD62856, sacR CAD62857 |
| L. sakei | | ScrA AAK92528 |
| M. laevaniformans | | LevM BAB59060 |
| P. multocida | NC_002663 | PtsB NP_246785, ScrR NP_246786, ScrB NP_246787, PM1849 NP_246788, 16S AY078999 |
| P. pentosaceus | Z32771 | ScrK CAA83667, ScrA CAA83668, ScrB CAA83669, ScrR CAA83670, 16S AF515227 |
| R. solanacearum | NC_003296 | ScrR NP_522845, ScrA NP_522844, ScrB NP_522843, 16S nt 1,532,714-1,534,226 |
| S. agalactiae | NC_004116 | ScrR NP_688683, ScrB NP_688682, Sag1690 NP_688681, ScrK NP_688680, 16S nt 16411-17916 |
| S. aureus | NC_002758 | ScrR NP_372566, ScrB NP_372565, 2040 NP_372564, 16S P83357 |
| S. mutans | M77351 | ScrK NP_722157, ScrA NP_722158, ScrB NP_722159, ScrR NP_722160, msmR AAA26932, Aga AAA26933, MsmE AAA26934, MsmF AAA26935, MsmG AAA26936, GtfA |

TABLE 4-continued

Genes and proteins used for comparative genomic analyses

| Bacterium | Genome or locus | Sequence information |
| --- | --- | --- |
| S. pneumoniae | NC_003098 | AAA26937, MsmK AAA26938, FruB AAD28639, FruA Q03174, 16S AF139603 ScrK NP_359158, ScrA NP_359159, ScrB NP_359160, ScrR NP_359161, 16S nt15,161-16,674, MsmR NP_359306, Aga NP_359305, MsmE NP_359304, MsmF NP_359303, MsmG NP_359302, GtfA NP_359301, ScrR2 NP_359213, Sbp NP_359212, MspA NP_359211, MspB NP_359210, SacA NP_359209 |
| S. pyogenes | NC_002737 | ScrK NP_269817, ScrA NP_269819, ScrB NP_269820, ScrR NP_269821, 16S nt 17,170-18,504 |
| S. sobrinus | | ScrB S68598, ScrA S68599 |
| S. typhimurium | | ScrK P26984, ScrAP08470, ScrR CAA47975, ScrB P37075, 16S Z49264 |
| S. xylosus | | ScrA S39978, ScrB Q05936, ScrR P74892 |
| T. maritime | NC_000853 | bfrA NP_229215, 1416 NP_229217, 1417 NP_229218, 16S AJ401021, 0296 NP_228108 |
| V. alginolyticus | | ScrR P24508, ScrB P13394, ScrK P22824, ScrA P22825, 16S AF513447 |
| V. cholerae | NC_002506 | 0653 NP_233042, ScrR NP_233043, 0655 NP_233044, 0656 NP_233045, 16S X74694 |

Many modifications and other embodiments of the inventions set forth herein will come to mind to one skilled in the art to which these inventions pertain having the benefit of the teachings presented in the foregoing descriptions and the associated drawings. Therefore, it is to be understood that the inventions are not to be limited to the specific embodiments disclosed and that modifications and other embodiments are intended to be included within the scope of the appended embodiments. Although specific terms are employed herein, they are used in a generic and descriptive sense only and not for purposes of limitation.

All publications and patent applications mentioned in the specification are indicative of the level of those skilled in the art to which this invention pertains. All publications and patent applications are herein incorporated by reference to the same extent as if each individual publication or patent application was specifically and individually indicated to be incorporated by reference.

Although the foregoing invention has been described in some detail by way of illustration and example for purposes of clarity of understanding, it will be obvious that certain changes and modifications may be practiced within the scope of the appended claims.

SEQUENCE LISTING (355 sequences)

SEQ ID NO: 1 - DNA, 1314 bp, Lactobacillus acidophilus
  CDS (12)..(1304): msmE gene, encodes an ABC substrate binding protein, ORF# 502
aaggaggaaaaatgaaaaaatggaaattaggagttgcagccattgcaactgtcgcagctttgtcactaactggctgtagtaataatagtcaaagtggcagtagtaacaacaaaaacgttactatgtgggttcacttttctaatactgatccggaaggtaaagcattacaaaagaatatcaatgactttaataaagagaataagcatggctataaagcaaaagttcaatatattcctcgttctggttcaggtggcggctatgaagataagatcaatgctgctttaaactcaggaagtttaccagatgttttaactttggatgctcctaacacagcagcttatgcacattcaaaaattattcaaccaatcgataagtacattactaataaagacgatattctaccaactattattaagcaaggtacttataaaggtaagttatatgctgctggctattcagaatcaagcatcggcttctattacaacaagaagatgttcaaagaggctgggattaaagattcagaaattgctactttacagcatccatggacttggactcaatttaaagatatttgtaagagacttaaaaaccacttccatgaaccagcaattaatatgaacttgaatgaccactcagaaatggctctttattcattagcaccatttgtatggtcagctggtggtagcattactaatcctgctggcacaaaggcagttggctactttaattccaagcaaactacttcagccttccaattaattcaagacatggtcaaagatggttacactactatttcaccaaaggataaaggttttgaaactggcaaatatgccatgatgatgactggtacttgggaagttcaaactttgcaaaaccaatacaagaatttgcaatggggcgtaatgccatatcctgtatctccagctactcacaaagaggtttcaccaacaggctcatggcaatacgcaatgtcttctgcagctaagaacaagaaggcagctggtgctttgattaacttcttaatgagtaagaagtgtatgtaccgcagcgatatggctaacactgttttgccagcacgtaagagtgtatctaagatgatgatgcctaaagttaatgaacaaatgagattcttcattaagcaaaaccaaactacgggtcatgctcgtccagttttagttaactacccacaagtaactagaacatttgctgatactgttcaaaatgtaactttgtacaagaagaatcctaatgtacaaaaggtaatgaacgaacaagctaaagttattcaaaagtaccttgagaaatagagaagta

SEQ ID NO: 2 - protein, 431 aa, Lactobacillus acidophilus
MKKWKLGVAAIATVAALSLTGCSNNSQSGSSNNKNVTMWVHFSNTDPEGKALQKNINDFNKENKHGYKAKVQYIPRSGSGGGYEDKINAALNSGSLPDVLTLDAPNTAAYAHSKIIQPIDKYITNKDDILPTIIKQGTYKGKLYAAGYSESSIGFYYNKKMFKEAGIKDSEIATLQHPWTWTQFKDICKRLKNHFHEPAINMNLNDHSEMALYSLAPFVWSAGGSITNPAGTKAVGYFNSKQTTSAFQLIQDMVKDGYTTISPKDKGFETGKYAMMMTGTWEVQTLQNQYKNLQWGVMPYPVSPATHKEVSPTGSWQYAMSSAAKNKKAAGALINFLMSKKCMYRSDMANTVLPARKSVSKMMMPKVNEQMRFFIKQNQTTGHARPVLVNYPQVTRTFADTVQNVTLYKKNPNVQKVMNEQAKVIQKYLEK

SEQ ID NO: 3 - DNA, 960 bp, Lactobacillus acidophilus
  CDS (47)..(928): msmF gene, encoding an ABC transporter permease, ORF# 503
ttattcaaaagtaccttgagaaatagagaagtaaaggggaatctttatgcaagttaaaggtataaagagacaaattgggtggctgtatgtttttccagctattctaattttactaacatttttaatcatcccatttttgatgtcatttagttattcttttacgaactataatattttgacaccatgggctaagcaatatgtaggttttacaaattacattaatacttttaaagatcctgtctttttacaaagtttaaaaaatattgcacaattcgttatctttattatgccgattcaggttggtgcggctttaggtttagctttaattgttaataaaaagcgtcctggaaatacattctttaagatttcattctttgcaccacaagttgtatctttgactgttgtctcaattctttggatgtatattcttaatcctgaccaaggcttgttaaatggtattttgggtatttttcacattaaaccacagccatttttaacttcacctaagcaagcgatgtttgctattatcggtgtatctgcttggcagggtgctggttatcagatgttaatctttttagcaggattacaaaatattcctgattcattgtatgaagcagctgaattggatggagcaaatagttggcaaagatttttacatattactttgccaatgcttaaacctacttcaattatgatcttaacgacgactttcattagtgctttcaacttgatgattcaaccaatgatcatgacccaaggtggcccacaaaatgctactatgacgccaatatactacatttatcgtacaggttttactgatcgtcaattaggatatgcaagtgcaatgagtgtaatctacggcattatcattatcatctttaccattattcaaagaaagatcacaaacgctggaggcgacgagaatgcataagtttatgacacatagaagattccatacga

SEQ ID NO: 4 - protein, 294 aa, Lactobacillus acidophilus
MQVKGIKRQIGWLYVFPAILILLTFLIIPFLMSFSYSFTNYNILTPWAKQYVGFTNYINTFKDPVFLQSLKNIAQFVIFIMPIQVGAALGLALIVNKKRPGNTFFKISFFAPQVVSLTVVSILWMYILNPDQGLLNGILGIFHIKPQPFLTSPKQAMFAIIGVSAWQGAGYQMLIFLAGLQNIPDSLYEAAELDGANSWQRFLHITLPMLKPTSIMILTTTFISAFNLMIQPMIMTQGGPQNATMTPIYYIYRTGFTDRQLGYASAMSVIYGIIIIIFTIIQRKITNAGGDENA

SEQ ID NO: 5 - DNA, 900 bp, Lactobacillus acidophilus
  CDS (24)..(878): msmG gene, encodes an ABC transporter permease, ORF# 504
cacaaacgctggaggcgacgagaatgcataagtttatgacacatagaagattccatacgatatggacaacagtgttaattactatattagccttattcttcttgttcccattagtttggatgattgtttcttcgatgaagccagaatcccaaatttatgctaacatcagtaatttaaaagctttcctaccatcaaaaaatatcggtgattggggaagcgcatatgcaagtatttttcatagattccctgtaatgagatacatttttaacagtgtattttatgcagcaagtgtaactattggatctattgtagtaaatgctttagctggatatggttttgcaaaatttaattttacaggacgtaaattattatttggtttattaattgcattattagttattcctggtactacgcttttaattcagcaattccaaattgctaaaagtattggtatcttgaacacttcattagcagttattttgcctggtatttcaagtcctttctatatttacatgtttagaaacgcttttgccgcgattccagatagtattacagaggcggcagaactagatggtgcaagtaattttaggaccttttggaatattttgttaccgatgactttaccaactgtagccactgttggaacactatcattcattggcagttggaatgactatgtatggccattaatggttttgactaattctgatcaattcccacttcaagtagctgttactaatattaacagcacaaacccagtctacatgaaccaagttatggctattttgaccatctctacagtacctttgattttggtttacatcttcttccaaaagtatcttactcaaggaatgggatctgcaggtaacggtgataaataatgaaggcaaatacttactt

SEQ ID NO: 6 - protein, 285 aa, Lactobacillus acidophilus
MHKFMTHRRFHTIWTTVLITILALFFLFPLVWMIVSSMKPESQIYANISNLKAFLPSKNIGDWGSAYASIFHRFPVMRYIFNSVFYAASVTIGSIVVNALAGYGFAKFNFTGRKLLFGLLIALLVIPGTTLLIQQFQIAKSIGILNTSLAVILPGISSPFYIYMFRNAFAAIPDSITEAAELDGASNFRTFWNILLPMTLPTVATVGTLSFIGSWNDYVWPLMVLTNSDQFPLQVAVTNINSTNPVYMNQVMAILTISTVPLILVYIFFQKYLTQGMGSAGNGDK

SEQ ID NO: 7 - DNA, 1380 bp, Lactobacillus acidophilus
  CDS (41)..(1330): bfrA gene, encodes a beta-fructosidase EC 3.2.1.26, ORF# 505
ttactcaaggaatgggatctgcaggtaacggtgataaataatgaaggcaaatacttacttatataaaaaaataagaaaaattgatcatgatgttttaagaccaacttttcacttcaatgctccagttggttggatcaatgatcctaatggattgatttattataaaaattattatcaattgtattatcaatacaatccatatgctccacactgggatagcatgcattggggtcacgctcgaagcaaagacggaatccattggcaagatatgccagtagcaatgaaaccggatcatgaatatgataaatcaggcgtattctcaggatctgccattgaaaaaggtggcaaattatatgtcatctatacgggacatgttgatgaaaatggtaaggcagttgaaacccaatgtgtagctgtttctgatgatggtgtagattttaaaaagtataaaaacaacccagtaatgacgatagccgatttacctggtgaagtagatgaaagtaactttcgtgatcctaaagtttttgaacatgatggtaaatactattgtgtaatagcagcagctattaatggtcacggcagtctgatcttgtttgaatcagaagatttacttcattggtcatttaaatctattttgctacaaggtgaaaaatatggattaatgacggaatgtccagattatttcaatatcgatggaaaagattatcttgcctttagtgtgattttaggtgatgacaaacatagtattgtttatatcgctgaaggacacatggattggcaaactttcaaatttgagttggaaaaatgtgatcgtttagacgatggagatgatttctacgcttctcaaagttttatgaatgaaaaaggcgaaagaattgtcattccatggttaagaagtgctgatcatgttaattatctagaagaatctggtcatctttggaatggaatgatgggaattccaagaaaattaactattgataataatgagttgattcaaagtccattaggtaaatttaaacaaatttcattgtcagatagtgagattactttaggaattaatcaattagccgaagatattccggttagctatagcttaatcttaaaaggcgacaatggagaaatttatattactcgtacaaatgagtcacagtacactatagacattcattcaccagcatttactgaagaacttgtatggcattcaaataagcataaattgacgttagtaattgataattctagtttagaaatttttagtcaaactaaaacgttaagtgtcgttacctttatcgctggaattaatcgaatggaacttaaaaaagtggatttgtaaggagataaataatgacagaagtagatttgaaccatgtatacaaaaag

SEQ ID NO: 8 - protein, 430 aa, Lactobacillus acidophilus
MKANTYLYKKIRKIDHDVLRPTFHFNAPVGWINDPNGLIYYKNYYQLYYQYNPYAPHWDSMHWGHARSKDGIHWQDMPVAMKPDHEYDKSGVFSGSAIEKGGKLYVIYTGHVDENGKAVETQCVAVSDDGVDFKKYKNNPVMTIADLPGEVDESNFRDPKVFEHDGKYYCVIAAAINGHGSLILFESEDLLHWSFKSILLQGEKYGLMTECPDYFNIDGKDYLAFSVILGDDKHSIVYIAEGHMDWQTFKFELEKCDRLDDGDDFYASQSFMNEKGERIVIPWLRSADHVNYLEESGHLWNGMMGIPRKLTIDNNELIQSPLGKFKQISLSDSEITLGINQLAEDIPVSYSLILKGDNGEIYITRTNESQYTIDIHSPAFTEELVWHSNKHKLTLVIDNSSLEIFSQTKTLSVVTFIAGINRMELKKVDL

SEQ ID NO: 9 - DNA, 1140 bp, Lactobacillus acidophilus
  CDS (25)..(1128): msmK gene, encoding an ABC transporter ATP binding unit ORF# 506
agtggatttgtaaggagataaataatgacagaagtagatttgaaccatgtatacaaaaagtatgatggaaatgataaatattcagtaaatgactttgatttacacatcaaagacaaggaatttatagtttttgttggtccatcaggttgtggtaaatcaacgaccttaagaatgattgcaggtttggaagatatcacagaaggtacgcttgaaatcgaccacatggttatgaatgatgtggctccgaagaatagagatatagcaatggtcttccagaactatgccttgtatccacatatgactatttatgacaatatggcatttggattgaagctaagacattatcctaaagaaaaaattgatacaaaagtaaagcatgcggctgagattcttggtttaactgattatttaaagaaaaagcctgccgctctttcaggtggtcaacgtcagcgtgttgcattaggtcgttcaattgttagggatgcacctatcttcctaatggatgagcctttgtcaaacttggatgctaaattgcgtgtatccatgcgtgcggaaattgctaaacttcatcaaagattaggtactactacaatttatgttactcacgatcaaactgaagctatgactttggcagatagagttgtagttatgtcagtaggtaaggtacaacaaattggtacacctttggaagtttataacaagcctaaaaacatatttgtagctggttttattggttcaccacaaatgaacttctttaatgttcattataagaatggccgtatttctgatggaaaaggcttgaatatggcaattcctaaaggtaaagccgatatgttggataagaaaggctatgacgataaggatattgtatttggtatcagaccagaagatattcacgccgaagaagcattcttagaaacttggccggatgcagtaattacctctactgttgtggtttcagaattacttggtgcaactattcaactttatcaaaaagttgatggtactgaattcgtcgcagatgtaaattcacgtgattatcacaagccaggtgatcaggtgaaaatgggctttgatattaataaggctcacttcttcgataaagatacgacaatggcaatctacaattaaacttaattt

SEQ ID NO: 10 - protein, 368 aa, Lactobacillus acidophilus
MTEVDLNHVYKKYDGNDKYSVNDFDLHIKDKEFIVFVGPSGCGKSTTLRMIAGLEDITEGTLEIDHMVMNDVAPKNRDIAMVFQNYALYPHMTIYDNMAFGLKLRHYPKEKIDTKVKHAAEILGLTDYLKKKPAALSGGQRQRVALGRSIVRDAPIFLMDEPLSNLDAKLRVSMRAEIAKLHQRLGTTTIYVTHDQTEAMTLADRVVVMSVGKVQQIGTPLEVYNKPKNIFVAGFIGSPQMNFFNVHYKNGRISDGKGLNMAIPKGKADMLDKKGYDDKDIVFGIRPEDIHAEEAFLETWPDAVITSTVVVSELLGATIQLYQKVDGTEFVADVNSRDYHKPGDQVKMGFDINKAHFFDKDTTMAIYN

SEQ ID NO: 11 - DNA, 1680 bp, Lactobacillus acidophilus
  CDS (148)..(1617): gtfA gene, encodes a sucrose phosphorylase EC 2.4.1.7, ORF# 507
aataaggctcacttcttcgataaagatacgacaatggcaatctacaattaaacttaattttctctcccccctcgattttaaaagaaagattaataatataatcctcgaagatcaaaacaattatgggttcaatcttttaaataaagattgaaccttttttataaggaaggtttaaaaatgaaattacaaaataaggcaatattgataacttatccagatagtttaggtcataatttgaaggacttggatcatgtaatggatcgctattttaataaaacgataggtggtattcatttattaccatttttcccttcaaacggtgatcgcggtttttctcctacaagatatgatgtagttgagcctaagtttggttcatgggaagatgtagaaaagttaagtcaaaagtattatttgatgtttgactttatgattaatcatctttctaaaaaatcctcatattttgaagattttgaagccaagcacgataaaagcaaatatagcgatcttttcttaagttgggataaattttggccaaagggcagaccaactaaagaagatatagatttaatttataaacgaaaagataaggccccatatcaaaatattaaatttgaagatggtactcatgaaaagatgtggaatactttcggcccagatcaaatggatttggatgttagaaccaagacaacacaagattttataaagcataatttacaaaatctttctaaacatggtgctagtttgattcgtttagatgcatttgcttatgcaattaaaaagttagatacaaatgacttctttgtagaaccggaaatttggaatttactcgaaaaggtaaatgattatcttaaagatactccaactactattctgcctgaaattcatgagcattatacgatgccatttaaggtggcagaacatggatactttatttatgattttgctttaccaatggtattgttgtattcactttatagcggtaatagtactcaacttgctgcttggctaaagaaatgtccgatgaagcaatttactactttagatacccacgatggattaggcgtagttgacgcaaaggatattcttacggacgatcaaattagctacacaacaaacgaactttataaaattggtgctaacgtcaagaagaaatattctagtgctgaatatcataatttggatatttatcaaattaatactacttattattctgcattgggtaatgatgataaaaaatattttattgcacggttattacaaatctttgcccctggtattccacaaatttattatgttggattgttagcaggagaaaatgatattcaattattagagaagacaaaagaaggacgcgatattaatcgccactattatgatttggatgagattgcggaacaagttcaaagacctgtagtaaaatctttgattaagttattggaatttcgtaattctgtacctgcatttgatttggaaggttcaatcaaagttgaaactccaagtgaacatgaaattattgtcactagatcaaataaggcaggaacagaagtagctagtacgtacgtagactttaagaacttagactatcaagttaaatacaatgatcaggtctttaatttttagaaattaagatatagtaaataaaaccatgaagtatatttgttgaatacttcgtggtttttt

SEQ ID NO: 12 - protein, 490 aa, Lactobacillus acidophilus
MNLFYKEGLKMKLQNKAILITYPDSLGHNLKDLDHVMDRYFNKTIGGIHLLPFFPSNGDRGFSPTRYDVVEPKFGSWEDVEKLSQKYYLMFDFMINHLSKKSSYFEDFEAKHDKSKYSDLFLSWDKFWPKGRPTKEDIDLIYKRKDKAPYQNIKFEDGTHEKMWNTFGPDQMDLDVRTKTTQDFIKHNLQNLSKHGASLIRLDAFAYAIKKLDTNDFFVEPEIWNLLEKVNDYLKDTPTTILPEIHEHYTMPFKVAEHGYFIYDFALPMVLLYSLYSGNSTQLAAWLKKCPMKQFTTLDTHDGLGVVDAKDILTDDQISYTTNELYKIGANVKKKYSSAEYHNLDIYQINTTYYSALGNDDKKYFIARLLQIFAPGIPQIYYVGLLAGENDIQLLEKTKEGRDINRHYYDLDEIAEQVQRPVVKSLIKLLEFRNSVPAFDLEGSIKVETPSEHEIIVTRSNKAGTEVASTYVDFKNLDYQVKYNDQVFNF

SEQ ID NO: 13 - DNA, 1380 bp, Lactobacillus acidophilus
  CDS (38)..(1318): purD gene, encodes a phosphoribosylamine-glycine ligase EC 6.3.4.13, ORF# 1551
catggtatttacaggttaccgtcactttagacactaattggtgagagctatgaaagatgatttagttttattggttgttggttcgggtggacgtgaatttgctgtggcaaaaaagctgaaggagagtccgcatgtgaagactgtgtattgtgcaccgggcaatgtggggatgcagacgatcggtgtcgaaaccgtgccgattgaagaaactgatcttgatggattgctagattttgctaaaagccacaatgtcgattggacttttgttggtccagaaaatgtcctttgtgctggcattaccgacaagtttaacaaagccgggcaaaagattttcggtcctaaccaaagagcggcacaactagaaggctcaaaagattatgctttacgcttcatgagtaaatacgatattccaactgctcgctatgaaacctatactagtgctgaaacctgtattgctggcttgaaggattttgaatatccagtagttatcaaggaagatggcctagctggcggcaagggcgtgacaattgctcaaaaccaagacgttgcagaagaaacgatcagggaaatgtttgctggtggtcaaattgctgtagtgcttgaagagtgcctggttggtcctgaatattcaatgtttgtggttgtctctgaagaccaatttacaattttgccaatggcacaggaccataagcgagtgggcgacggcgacaagggcccaaatactggcggtatgggatcatattctcctttgccacagctgaaaaaagcagatcgtcaaagaatgattgatgaaattgtgaagccaacgatgaatggcctggttcaaggaatttatcattattgtggtgtgctatacatcggcttgatgatgactgagagtggccctaaggtcattgaatataacgttcgcttgggcgatccagaaactcaagttgtcttgccacgcattaaaaatgattttgccatggtaattgatgcggcagtaaatcatgagaagctgcctgagattgaggaaaatgataattgcgtgttaggcgtggttgtctgcagcaaaggctatccaacgcacccagcacctaatgttaagatcggcaagctgcctgaaggtgctaatacctatatcgattacgccaatgttaaaggtgatttggaaaacttgacgggtgatggtggccgcttgttcatggtgatttcggaagctgacaatttagttcaggcacaagacaatgtttattcttatttaagtaagcttgatctgctggattgcttctaccggcatgatattggtaatcgtgctttgggagattttaatattatataatgtcttaacttaatgacattgataaggctacccatattttgtttatttgtaatcctgtg

SEQ ID NO: 14 - protein, 427 aa, Lactobacillus acidophilus
MVRAMKDDLVLLVVGSGGREFAVAKKLKESPHVKTVYCAPGNVGMQTIGVETVPIEETDLDGLLDFAKSHNVDWTFVGPENVLCAGITDKFNKAGQKIFGPNQRAAQLEGSKDYALRFMSKYDIPTARYETYTSAETCIAGLKDFEYPVVIKEDGLAGGKGVTIAQNQDVAEETIREMFAGGQIAVVLEECLVGPEYSMFVVVSEDQFTILPMAQDHKRVGDGDKGPNTGGMGSYSPLPQLKKADRQRMIDEIVKPTMNGLVQGIYHYCGVLYIGLMMTESGPKVIEYNVRLGDPETQVVLPRIKNDFAMVIDAAVNHEKLPEIEENDNCVLGVVVCSKGYPTHPAPNVKIGKLPEGANTYIDYANVKGDLENLTGDGGRLFMVISEADNLVQAQDNVYSYLSKLDLLDCFYRHDIGNRALGDFNII

SEQ ID NO: 15 - DNA, 1620 bp, Lactobacillus acidophilus
  CDS (56)..(1594): purH gene, encodes a phosphoribosylaminoimidazolecarboxamide transformylase EC 2.1.2.3.3.5.4.10, ORF# 1552
cagctacgttaaaaaaagtattaagtcaaagaatggaaaaggaagaaaaacaaaaatgaaacgagcattaatcagcgttagtgataagaccaacttggtagattttgctaaaggtttagttcaaaacggctatgaaattatttctaccggtggtaccaagaagactttggacgaagctggtgttaagacaatcagcgttgaagaagttactaattttcctgaaattttagatggtcgtgtaaagactttaaacccatatattcatggcggacttcttgctaagagagacgatcttgaacacatggcaactttagagaaattaaacattaagccaatcgatctagtttgcgtcaacctttatccatttaagcaaactattgaaaagccagacgttactactgaagaagcgatcgaaaacattgatattggtggtccaagcctcttgcgtgctgcttcaaagaactatcaagacgttactgtcgtaaccgataaaaacgactatgacttagttttaaaagaaattgctgaaaaaggtaacaccactcttgaaacaagagctaagctagctgcaaaagtctttagagcaaccgccgcttatgatgcagttattgccaactacttaactaagcaagttggacttgaagatcctgaaaaattgactttgacttatgatttgaaagaaaaaatgcgctatggtgaaaactcacaccaaaaggcatggctttacgaagatgcaattccaaagagcttctcaattttgcaagcacatcaattgcacggcaagaagctttcttacaacaacattaaggatgctgatgaagcacttcgttgtattcgtgaatttcaagatgagccaaccgttgttgcgatgaagcatatgaacccatgtggtattggtcgcggcgacacgctcgaagaagcatgggacagagcatacgaagcagattcagtttcaatctttggcggcgttatcgctttgaatagaaaagttgatttagccactgctaaaaagatgcacaagattttcttggaaattatcattgcaccaggctttgatgatgatgcactcgaagttttggaaaagaaaaagaatattagattgcttaaactagacttcagtaaagaaaatgaaccaactcgtccagaaattgtttcagtcatgggtggtattttgcaacaagaacaagatactttggttgaaaacactgacgactggaaggtagttactaatgcgcagccaactgaagcacagcttaagacaatgatgttcgctttaaaagcggtaaaacatactaaatctaatgcgattgtggttgctaacgatgagagaactcttggtgttggtgcaggtcagcctaacagaattgattctgctaaaattgcgattaaacatgctggggatgcaatcgatgatcgtgcagtcctttcatcagatgctttcttcccatttaatgattgtgtagaatatgcagcaaagcatggcattaaggcaatcgttcaacctggtggttctattcgcgataaagattcaattgaaatagctgacaagtacggcgtagccatggtatttacaggttaccgtcactttagacactaattggtgagagctatgaaagatga

SEQ ID NO: 16 - protein, 513 aa, Lactobacillus acidophilus
MKRALISVSDKTNLVDFAKGLVQNGYEIISTGGTKKTLDEAGVKTISVEEVTNFPEILDGRVKTLNPYIHGGLLAKRDDLEHMATLEKLNIKPIDLVCVNLYPFKQTIEKPDVTTEEAIENIDIGGPSLLRAASKNYQDVTVVTDKNDYDLVLKEIAEKGNTTLETRAKLAAKVFRATAAYDAVIANYLTKQVGLEDPEKLTLTYDLKEKMRYGENSHQKAWLYEDAIPKSFSILQAHQLHGKKLSYNNIKDADEALRCIREFQDEPTVVAMKHMNPCGIGRGDTLEEAWDRAYEADSVSIFGGVIALNRKVDLATAKKMHKIFLEIIIAPGFDDDALEVLEKKKNIRLLKLDFSKENEPTRPEIVSVMGGILQQEQDTLVENTDDWKVVTNAQPTEAQLKTMMFALKAVKHTKSNAIVVANDERTLGVGAGQPNRIDSAKIAIKHAGDAIDDRAVLSSDAFFPFNDCVEYAAKHGIKAIVQPGGSIRDKDSIEIADKYGVAMVFTGYRHFRH

SEQ ID NO: 17 - DNA, 660 bp, Lactobacillus acidophilus
  CDS (57)..(656): purN gene, encodes a phosphoribosyl glycinamide transferase EC 2.1.2.2, ORF# 1553
aattgacggctcgtccagcaggcaaagccaagatcgtcatcgaatagaggataaaaatgagagttgctattttagcctctgggaatggaactaactttgaagcgttaactaaacagtttcaagtaggcgaaattcctggaaacgaagctttaatgttttgcaatcatccgaatgctcaggtaattaaaagagccgaaagattaggtgtgccgcacgaaactttttccgttaaagaatgtggcggtaaagatacttatgaagaacgtctactaaaagttttgcaggattatcaaattgatttcattgttttgtctggatatctaagaatggttggtcccaagattttaaatgaatatccaaattcaatcatcaacttacatcccgcattactacctaattatccaggtcttaattcaatcgaaagagcatttgatgattataaaaaaggcaaaataaaagaaactggcgtcacagtccactttattgatgtccatttggatcacggtccaatcattgctcagcaagttgtaccaatctatcctgatgatacagttgatacgcttgaagcaagagttcatgaaacagaacacaaattattcccagctacgttaaaaaaagtattaagtcaaagaatggaaaaggaagaaaaacaaaaatgaa

SEQ ID NO: 18 - protein, 200 aa, Lactobacillus acidophilus
MRVAILASGNGTNFEALTKQFQVGEIPGNEALMFCNHPNAQVIKRAERLGVPHETFSVKECGGKDTYEERLLKVLQDYQIDFIVLSGYLRMVGPKILNEYPNSIINLHPALLPNYPGLNSIERAFDDYKKGKIKETGVTVHFIDVHLDHGPIIAQQVVPIYPDDTVDTLEARVHETEHKLFPATLKKVLSQRMEKEEKQK

SEQ ID NO: 19 - DNA, 1080 bp, Lactobacillus acidophilus
  CDS (30)..(1064): purM gene, encodes a phosphoribosylformylglycinamide cyclo-ligase EC 6.3.3.1, ORF# 1554
caagaacggcgaaaaagaaaggaataaagatgaatcgttataaagaagcaggcgttgacgttactgccggatacgatttggttaatcgaatcaagcccttagtggctgcaaccaagcgtaaaggtgtgatgggcagcattggtagttttggcgggatgttcgatttagaagaattaggctacaagcatcccgttctcgtctcaggtaccgatggcgttggtactaagttgatgatcgcccaaaagatgcacaaaaacgacactgtcggcatcgactgcgtggccatgtgcgttaacgatgtgctagctcaaggcgcagaacctttatttttcctagattacatcgcatgcggacacaacgatcctgaaagattagctgatgttgttaaaggtgtagccgaaggctgcaagcaaagcgggtctgccttgattggtggcgaaactgccgaaatgccagatatgtatgagccacatgaatacgatctggccggcttttccacagggattgcggaaaaagaagacttgttatcaagttctttagctaaagcaggtgatcatctgattgccttgccatcaagcggcgtccattcaaatggttttagtttaattagaaaaatcttgttcaaagatcacgacgtttcattagacgataagccagcagaattatcaggcaagactgttggtgaaacactacttacgccaaccagaatctatatcaaagctgttttgccactagtaaaaaagcatttgattcacggcattgcccatatcactggcggcggcttcatcgaaaacttgccacgtatttatgacgataatctgcaggcggtgattaataaaggatcttggcctggtttaccgatttttgattatttgaaaaaaataggcgtattgagtgatcaagattgctacaacaccttcaatatgggcatcggattagtattagccgtttcatcagaaaatgttgatgcagtcaaagaacagctgaataccgaaaatgaagaattttatgaaataggtaaattgacggctcgtccagcaggcaaagccaagatcgtcatcgaatagaggataaaaatga

SEQ ID NO: 20 - protein, 345 aa, Lactobacillus acidophilus
MNRYKEAGVDVTAGYDLVNRIKPLVAATKRKGVMGSIGSFGGMFDLEELGYKHPVLVSGTDGVGTKLMIAQKMHKNDTVGIDCVAMCVNDVLAQGAEPLFFLDYIACGHNDPERLADVVKGVAEGCKQSGSALIGGETAEMPDMYEPHEYDLAGFSTGIAEKEDLLSSSLAKAGDHLIALPSSGVHSNGFSLIRKILFKDHDVSLDDKPAELSGKTVGETLLTPTRIYIKAVLPLVKKHLIHGIAHITGGGFIENLPRIYDDNLQAVINKGSWPGLPIFDYLKKIGVLSDQDCYNTFNMGIGLVLAVSSENVDAVKEQLNTENEEFYEIGKLTARPAGKAKIVIE

SEQ ID NO: 21 - DNA, 1500 bp, Lactobacillus acidophilus
  CDS (1)..(1464): purL gene, encodes a phosphoribosylpyrophosphate amidotransferase EC 2.4.2.14, ORF# 1555
ttggaaggagtgcatcccttgtttaatgaaatcaaaagcctaaatgaggaatgtggcatcttcggagtttttggagctcctaatgctagtcaattaacctatttaggcttgcataacttacagcaccgcggccaagaaggggccggcattgtttcaagtgatggcgagcatttataccaacaccgcgatcgtgggcttctatccgatgcctttgccgatcctaacgatttaaaaaagctagtcggtgacagtgctataggccatgttcgctacagtacgacggggcgcaattcgattcaaaatgtgcagccatttctttttcactttctcgatggggatgtggctttagctcacaacggtaatttagttaacgccgtgtctttacgagacaagctggaaaaacaaggtgcaatttttcaatcttcatctgataccgaaattttaatccacttgattcgtaatcatattaaagatggttttatttcggcattaaagcaaggtttaaacgaagttcatggcggttttgccttcttgcttttacaaaaagatcgcatgattgcagccctggatcctaacggaatcagacctttatgcattggccagcttgataatggcgcatacgttgtttctagtgagacttgcgcgctagacataattggtgccaaatttgttcgcgacgttcaaccgggtgaattaatcatcattgatcgagatgggatgaaaattgatcattttactgaggatactcatttagcaatctgttcaatggaatacatctattttgctcgacctgattcgattattcacggcgtgactgtccacaatgctagaaagagaatgggacgactgctggctcgtgaagccccagccgatgttgatatggtaattggcgtgccgaattcatctttgtcagctgcttctggttacgctgaagagttacatttgccatacgaaatgggactagttaagaatcaatatgttgctagaaccttcatccaacctacgcaagccttgcgtgaaaagagcgtgaagttgaagctttcggctgtacgaggcgttgttgctggtaaaaagatcgctgtcattgacgattcaattgtaagagggacaacttctaagcaaattgtcagaatgcttaaagaagtaggtgccaaagaagttcacttgagaattgctagtccaccatttaaatttccttgtttttacggcattgacatttcaactcgggctgaattaatagctgctcattattcagtagaagaaatgcgtaaaatcatcggtgctgatagccttggctttttgagcgttgatagcttgattaaagcaatcaatgtgcctgatcgtggagacttatcggggctgacagttgcttactttaatggtaaatatccaactaaattggatgactacgaagctggatacttagcttctcttaatgctcaagaacggcgaaaaagaaaggaataaagatgaatcgttataaagaagcaggcgttgacg

SEQ ID NO: 22 - protein, 488 aa, Lactobacillus acidophilus
MEGVHPLFNEIKSLNEECGIFGVFGAPNASQLTYLGLHNLQHRGQEGAGIVSSDGEHLYQHRDRGLLSDAFADPNDLKKLVGDSAIGHVRYSTTGRNSIQNVQPFLFHFLDGDVALAHNGNLVNAVSLRDKLEKQGAIFQSSSDTEILIHLIRNHIKDGFISALKQGLNEVHGGFAFLLLQKDRMIAALDPNGIRPLCIGQLDNGAYVVSSETCALDIIGAKFVRDVQPGELIIIDRDGMKIDHFTEDTHLAICSMEYIYFARPDSIIHGVTVHNARKRMGRLLAREAPADVDMVIGVPNSSLSAASGYAEELHLPYEMGLVKNQYVARTFIQPTQALREKSVKLKLSAVRGVVAGKKIAVIDDSIVRGTTSKQIVRMLKEVGAKEVHLRIASPPFKFPCFYGIDISTRAELIAAHYSVEEMRKIIGADSLGFLSVDSLIKAINVPDRGDLSGLTVAYFNGKYPTKLDDYEAGYLASLNAQERRKRKE

SEQ ID NO: 23 - DNA, 2280 bp, Lactobacillus acidophilus
  CDS (35)..(2260): purL gene encodes a phosphoribosylformylglycinamidine synthase EC 6.3.5.3, ORF# 1556
tatttaagtcacttttgaaagcaggagttcaagcatgaaacaagcgatgacaccagaagaaatcaaagaaaagaagccttaccttgattggagcttatcagaacatgaatatgactatatttgtgatcatttgcttcatcgcttgcctaactatactgaaatcggtttgttctccgcaatgtggagtgaacactgttcttacaagaaatccaagccagtactaaagcttttcccaactaagggtaaacgtgttgtccaaggcccaggtgaaggtgccggcgtagttgatattgatgatggacaagcagttgtgttcaaagctgaaagtcacaaccacccaactacagttgaaccttaccaaggtgccgcaactggtgttggcggtattttaagagatgttttcagtatgggagctcgtccagtcgcaatccttgattcgcttcactttggtgaattaaaggataatccaacaatgcgttacaagatggaagaaactatcaagggcgtgggcgactatggcaactgcatgggaatccctaacttaggtggtgaaaccacctttgatccttgctataacggcaacattttgcttaacgcaatgaacgtcggcattatggatatcaaggatatggaacatggggatgccacaggtgtcggcaatgcagtaatgtatgtcggtgctaaaactggtcgtgacggtatccacggtgcaacttttgcttcagccgacttttctgaagaacatgctactcaacgttcagcggttcaagttggtgatccatttatggaaaagcttttgatggaagcctgcctggaattgattttgcatcaccgcgaatggctcgtcggtattcaagacatgggtgcagctggaatcgtatcttcaagtgctgaaatggccactgaaggtaaatctggcatggatcttaatttgaacttggttcctcaacgtgaacctaatatgtcagcttacgagattatgcttagcgaatcgcaagaaagaatgcttctttgcgtgaagaagggtcacgaagaagacgttaaaaagatttttgatgaatataatcttgatgcagtgactattggtcgaattactgatgatggcagatatgttcttcatcatgatgatcaagtagtttgcgacattccagttgtaactttgactgaaaaggttcttgaagaaaaaagcgaagagaaaaagccacaaagaattattgatgtagaacaaagcgaaaactggcaacctgagattgaagatgcaggtcaaaccttaagagctcttttgaatcaaccaactattgctaatgatcaatttgtaacacaacaatatgactcacaggttcgcacagatactattgttggtcctggttcagatagcgggattctgcgtgttcgccatactaagaaggcaatcgccatgacaactgataccaatggtcgttttgtctatcttgatcctaaagttggcggacaaagaacagtccttgaaagtgccacaaacattgtagctagtggtgctttgcctttagctattaccgactgccttaactatggtgatcctaatgatccagaaatcttctgggaattacaccaatcttgccaaggaattgccgatgcatgtgagatcttagaaacaccagttgtttcaggcaatgtttctctttataacgaaaacaacggtaaggcaatttatccatcgccaatgatcggtatggtgggattgatcaaaaactatgatcatgtcattccaatgcatatgcaaacagcaggcgacaagatttatctcgttggtaaaacagatgatgattttgctggttcagaattgcaaaagatgatgacaggtaaaattagcggcttgccacatgcaccaaatttgccaggaatcaaagactacctatataaattgcaaaaattaatggcagaaggacttgtccaaagtgctcatgatttaagcgaaggtggcttaggcgtatccttagctgaaagtgtatttgatactgatcttggcgtaaacgtaaaactcgattttaataaaaatcttttgttcagtgaaactccaggacgcttgatcgtttccgtcgctcctgaaaatgcggcaaagtttgaacaagaaatgggcgatgcagttagcgaaattggtcaagttacagatgacaagcaattaaatatttctcttacaaatgatcaagtaaatgaagatgttgcgaaattgcaaaagatttggaaggagtgcatcccttgtttaatgaaatcaaaagcctaaatgaggaatgtggcatc

SEQ ID NO: 24 - protein, 742 aa, Lactobacillus acidophilus
MKQAMTPEEIKEKKPYLDWSLSEHEYDYICDHLLHRLPNYTEIGLFSAMWSEHCSYKKSKPVLKLFPTKGKRVVQGPGEGAGVVDIDDGQAVVFKAESHNHPTTVEPYQGAATGVGGILRDVFSMGARPVAILDSLHFGELKDNPTMRYKMEETIKGVGDYGNCMGIPNLGGETTFDPCYNGNILLNAMNVGIMDIKDMEHGDATGVGNAVMYVGAKTGRDGIHGATFASADFSEEHATQRSAVQVGDPFMEKLLMEACLELILHHREWLVGIQDMGAAGIVSSSAEMATEGKSGMDLNLNLVPQREPNMSAYEIMLSESQERMLLCVKKGHEEDVKKIFDEYNLDAVTIGRITDDGRYVLHHDDQVVCDIPVVTLTEKVLEEKSEEKKPQRIIDVEQSENWQPEIEDAGQTLRALLNQPTIANDQFVTQQYDSQVRTDTIVGPGSDSGILRVRHTKKAIAMTTDTNGRFVYLDPKVGGQRTVLESATNIVASGALPLAITDCLNYGDPNDPEIFWELHQSCQGIADACEILETPVVSGNVSLYNENNGKAIYPSPMIGMVGLIKNYDHVIPMHMQTAGDKIYLVGKTDDDFAGSELQKMMTGKISGLPHAPNLPGIKDYLYKLQKLMAEGLVQSAHDLSEGGLGVSLAESVFDTDLGVNVKLDFNKNLLFSETPGRLIVSVAPENAAKFEQEMGDAVSEIGQVTDDKQLNISLTNDQVNEDVAKLQKIWKECIPCLMKSKA

SEQ ID NO: 25 - DNA, 720 bp, Lactobacillus acidophilus
  CDS (27)..(695): purQ gene, encodes a phosphoribosylformylglycinamidine synthase EC 6.3.5.3, ORF# 1557
aagattaaagttttggaggaaaatgcatgaaaattgcagtagttgtttttccaggctctaattgcgacatcgatatgtacgaagcctttcacactgtttgcaaggatgatgtcgaatatgtttcttacaaagaaaagagcttggatggcttcgatgtagttgttttgcccggtggtttttcctacggtgactacttaagaaccggtgccattgctcgtttttcaaatattattccagccgttgaaaatatggcaaaggaaggaaagctggtcttaggtgtctgcaatggttttcaaattttaacagaaatgggattgcttcccggagcacttaagaaaaacgatagccttcaattcgtttgcaaaaccgtaaccttagaagttgaaaatatgcatacgccatttactaatgaatatgctgataaagagtttatccaaattcctattgctcacggtgatggcagctattacgcagatgaaaatgtgctagaagaactagaagataatcatcaggttgtctttagatatcatggtgaaaatcctaacggtagtcttcacgacatagctggtatctgtaacaaagaaggcaatgtattaggtatgatgcctcaccctgaaagagccgttgaagaaattctcggtggaatagatggtttgcctttatttaagtcacttttgaaagcaggagttcaagcatgaaacaagcgatgacaccagaaga

SEQ ID NO: 26 - protein, 223 aa, Lactobacillus acidophilus
MKIAVVVFPGSNCDIDMYEAFHTVCKDDVEYVSYKEKSLDGFDVVVLPGGFSYGDYLRTGAIARFSNIIPAVENMAKEGKLVLGVCNGFQILTEMGLLPGALKKNDSLQFVCKTVTLEVENMHTPFTNEYADKEFIQIPIAHGDGSYYADENVLEELEDNHQVVFRYHGENPNGSLHDIAGICNKEGNVLGMMPHPERAVEEILGGIDGLPLFKSLLKAGVQA

SEQ ID NO: 27 - DNA, 300 bp, Lactobacillus acidophilus
  CDS (16)..(267): purS gene, encodes a phosphoribosylformylglycinamidine synthase, ORF# 1558
cttaaggagatctaaatgactactattcgtatctacgtaacctacaagccttcagtttttgatccacaaggagccgcaatcaccaattcagttaattcccttggtcatgacgaagttaagaaaatagttgttggtaagttcttcgatgtaaccgtagacgaagatgatttggataaagttaaggctgatgtaaaagatatcgctgaatcattactagtcaacttcaatatggaaacttacaagattaaagttttggaggaaaatgcatgaaaattgcagtagttgtttttccaggctcta

SEQ ID NO: 28 - protein, 84 aa, Lactobacillus acidophilus
MTTIRIYVTYKPSVFDPQGAAITNSVNSLGHDEVKKIVVGKFFDVTVDEDDLDKVKADVKDIAESLLVNFNMETYKIKVLEENA

SEQ ID NO: 29 - DNA, 840 bp, Lactobacillus acidophilus
  CDS (79)..(792): purC gene, encodes a phosphoribosylaminoimidazole-succinocarboxamide synthase, ORF# 1559
atattgttagcataaaagtgaacgaataattattcgcttgccagaaatgttcgtgttttttaccaaggagaaagaaaaatggcaaagttgttgtataccggtaaagttaaagaaatgtggtctacagatgacccagaagttttacgcgtggtttataccgaccaagcaactgccggtaacggtgagaagaaggatgactttaagaacaaagcctatttaaacaacgagatttcaaccttaatttttgaatatttagccaaaaacgggattccaactcatttcatcaagaagatttcagacacagaagaattagttaaaaagtgtgaaatgttcccacttgaagttgttactagaaatatagcagctggtcacttttcaagtcgctatgggatgggcgaaggtgaaaaattcgatacgccagttgaagaattgttctacaagagcgatgaacttgatgacccaatcatgaatgaatctgatgcgatcgcattgcatatcgccactgcagaagaacaaaagaaaatctgggaattatcacgtcaagttaacaagcttttgattccactttttgataaagcaggaatggaattagttgacttcaaacttgaatttggtaaagatgcagatggaaatatcatcctcgcagacgagttttcaccagataactgccgcctttgggataaaaagactaaggagcacatggataaagatgtctaccgcagagacatcggtgacttaaccaccgtttatgaacaagacttagcccgcattcaagaagcacttaaggagatctaaatgactactattcgtatctacgtaacctacaagccttcagttttt

SEQ ID NO: 30 - protein, 238 aa, Lactobacillus acidophilus
MAKLLYTGKVKEMWSTDDPEVLRVVYTDQATAGNGEKKDDFKNKAYLNNEISTLIFEYLAKNGIPTHFIKKISDTEELVKKCEMFPLEVVTRNIAAGHFSSRYGMGEGEKFDTPVEELFYKSDELDDPIMNESDAIALHIATAEEQKKIWELSRQVNKLLIPLFDKAGMELVDFKLEFGKDADGNIILADEFSPDNCRLWDKKTKEHMDKDVYRRDIGDLTTVYEQDLARIQEALKEI

SEQ ID NO: 31 - DNA, 1530 bp, Lactobacillus acidophilus
  CDS (46)..(1500): scrB gene, encodes a sucrose-P hydrolase, ORF# 400
tagaattaatattaaagataacgcttacatggaggcttttttattatggaatggacaagagaaaaacgttatttaccttatagtaaatgggatgctgacacattacttcatttgcaagcacaagcagcaaactccccttaccaaatgcactatcatttacatccaatttctggattaatcaatgatccaaatggtttttcatattttaatggtgcttaccatctgttttatcaatcatacccatttggtgcagttcacggactaaaatcttgggttcacttcaagtcaaaagatttagtccattgggaaaatttaggtttagctattgagccagatacaatggctgattcacacggtgcctactctggctcagcccgtgaaatcgatggcaaattattcttaatgtacacgggtaaccaccgtgatgaaaactggattcgtactccttaccaaattggtgcttggatggataaaaatggcaaagtttctgataaaactatcctctttaagaatcctgaccacatcaccgaacatttccgtgatccacaaattttaaagaaaaacgacacttactatgcaattttaggtgcacaagataacgccgaaaaacatggtcacattgatgtatggaaatcaaaagatttaaagaattgggaagaattaggctatctagattttacggatcaagacatgggttatatgatcgaatgccctaatcttgttgaagtagatggtcatgtggtgttgattttctgtcctcaaggattagataaaaaagtagctgattatgatgatatctatccaaatatgtatgtcattgctgatggaatcgattttgaaaaccataaattaattaatccaggtccactacaaaatttggataaaggtttcgatgtatatgctactcaagcatttaatgcacttgatggaaaagcatatgaaatcagctgggtaggtttacctgatataacttatccaactgatgatgaaaattgggcaaattgcttaagtcaagttaaagaacttactatcaaaaatggtcaattaattcaaaaaccagttaagtcgatggctagtcttcataaaaatgaaaaagatgtagctgatcaagttgtttctgaaaatgctggtcaacaatatgaattagagcttacaattaaagctggccaaaaaggaaatctctatctagctgcaaatgacgatttaagtagtggattaaagatcagctttgatactaaaaacggacaattaattttagatcgttctattgctggtcaaaaagtagcagtagattatggtgaaaatagaactgccccacttcaacctgatagcgatgtaaaattaaatatttatattgatcattcattaattgaaatttttgttaatgacggtgaaaatgtattaactggtcgttatttcgctgatcaagcacattctaagattgcatttgataaaaagattaactttaacggtaaactttggaatatgaaaacaattctttaatattaaggtgatatagatgcccgctaa

SEQ ID NO: 32 - protein, 485 aa, Lactobacillus acidophilus
MEWTREKRYLPYSKWDADTLLHLQAQAANSPYQMHYHLHPISGLINDPNGFSYFNGAYHLFYQSYPFGAVHGLKSWVHFKSKDLVHWENLGLAIEPDTMADSHGAYSGSAREIDGKLFLMYTGNHRDENWIRTPYQIGAWMDKNGKVSDKTILFKNPDHITEHFRDPQILKKNDTYYAILGAQDNAEKHGHIDVWKSKDLKNWEELGYLDFTDQDMGYMIECPNLVEVDGHVVLIFCPQGLDKKVADYDDIYPNMYVIADGIDFENHKLINPGPLQNLDKGFDVYATQAFNALDGKAYEISWVGLPDITYPTDDENWANCLSQVKELTIKNGQLIQKPVKSMASLHKNEKDVADQVVSENAGQQYELELTIKAGQKGNLYLAANDDLSSGLKISFDTKNGQLILDRSIAGQKVAVDYGENRTAPLQPDSDVKLNIYIDHSLIEIFVNDGENVLTGRYFADQAHSKIAFDKKINFNGKLWNMKTIL

SEQ ID NO: 33 - DNA, 2040 bp, Lactobacillus acidophilus
  CDS (40)..(1986): scrA gene, encodes a sucrose PTS, ORF# 401
gaattgagaataaaagcgtttacataggaggaaacaaatatggaccacaagaaagtggctgaacgagtaattaaagatgtgggtcgtgacaatattattgccggtgctcactgtgctactcgtttgcgtttagtattgaaagatgattccaaggttgaccaaaaggctctggataatgatccagatgttaaaggtacttttaaaactaatggtcaatatcaagtgattattggaccaggagatgttaatgacgtttatgacgaattcattaagatcactggattaaaggaattatcaactgatgacttgaagaaggtagcagctgaaggccaaaagaagaatcctatcatggacttcattaaacttttgtctgacatcttcgttccaattattccagctttagttgctggtggtttgttaatggcattgaacaatttcttaacttcacctggacttttcggtccgaagtcagttgttcaaatggctcctaacgttgccggaatatcaagtatgattcaggtaatgtcggctgctccatttatctttatgccaatccttgtaggtatgtcagcggcaaaaagattcggcgctaatcaattcctgggtgctacaattggtatgattatgaccaccccaggacttggtggtgcaactaaattctgggatatctttggcttacatgtcgcacaaactaattatcaatatcaagttattccagttttagtagctgtatgggtattgtcaatttttgaaaaatacttccataagcatttaccatctgcagttgactttacctttacaccacttctttcaattatgattactggtttcttaactttcactattattggaccagtatttaagggtgtatctgacgcaattactaatgctatcgtatggctttacgatactactggtgcctttggtatgggtgtctttggtcttagttattcagctattgttactactggtcttcaccaaagtttcccagctgttgaaactcaacttttggcagcctttgctaagaatccagcaagttctggtgactttatctttgttactgcatgtatggctaatgtagctcaaggtgctgcaactttcgcagtctacttcttaactaagaacaagaagatgaaaggcttggcaagttcctcaggtgtttcagcccttcttggtattactgaaccagcattattcggtgttaacttaaaatacaaattcccattcttctgtgctttgattggttcaggtgttgcagctgcttttgcagggttgatgcacgtaactgctgccgcacttggttcagctggtttccttggttttctttcaatttatccaagaactattccaatgtgggttgtttctgtagcaattagttttgcagtttcattcattctcacttatgtttatggtaagagccacttgaaggaagaagtcgctgaacaagatgttccagtaaatgatgcaactgactacgctgaagaaactcaaaaagctgaaaagattggtaaagaacaattagcattaaaggatgaaattatttactccccagttgacggtactccagaaagcttaactaaagttaatgatcaagtattctcagctaagttaatgggtgacggtgccgcagttattccaagtgacggcactatctatgctccagtaactggtactgtaacaattgcttatgaaactaagcatgcttatggtattaaatcagatgatggtgctgaagtattaattcacattggtcttgataccgtaaaccttaagggtgaacactttgaaagctttgtaaaacaaggtcaacgtgttgaaaaaggcgacaagcttggcagcgttgatttagatgctgttaagaaggcaggttatgacactactgtcatggttgttattactaacactgccaactatgcaaatgttcaacgcattactgatgcaggtgacaagcacggtgataagctgattgctgttactgctcacgaataattgttaacgctcctctatgaatcaaaattaaaacaattattaattatgaag

SEQ ID NO: 34 - protein, 649 aa, Lactobacillus acidophilus
MDHKKVAERVIKDVGRDNIIAGAHCATRLRLVLKDDSKVDQKALDNDPDVKGTFKTNGQYQVIIGPGDVNDVYDEFIKITGLKELSTDDLKKVAAEGQKKNPIMDFIKLLSDIFVPIIPALVAGGLLMALNNFLTSPGLFGPKSVVQMAPNVAGISSMIQVMSAAPFIFMPILVGMSAAKRFGANQFLGATIGMIMTTPGLGGATKFWDIFGLHVAQTNYQYQVIPVLVAVWVLSIFEKYFHKHLPSAVDFTFTPLLSIMITGFLTFTIIGPVFKGVSDAITNAIVWLYDTTGAFGMGVFGLSYSAIVTTGLHQSFPAVETQLLAAFAKNPASSGDFIFVTACMANVAQGAATFAVYFLTKNKKMKGLASSSGVSALLGITEPALFGVNLKYKFPFFCALIGSGVAAAFAGLMHVTAAALGSAGFLGFLSIYPRTIPMWVVSVAISFAVSFILTYVYGKSHLKEEVAEQDVPVNDATDYAEETQKAEKIGKEQLALKDEIIYSPVDGTPESLTKVNDQVFSAKLMGDGAAVIPSDGTIYAPVTGTVTIAYETKHAYGIKSDDGAEVLIHIGLDTVNLKGEHFESFVKQGQRVEKGDKLGSVDLDAVKKAGYDTTVMVVITNTANYANVQRITDAGDKHGDKLIAVTAHE

SEQ ID NO: 35 - DNA, 840 bp, Lactobacillus acidophilus
  CDS (61)..(810): Glycerol uptake facilitator protein, ORF# 1595
taattttgtcttgtatgtatttttcacttattttttctagaggagtaaaaagtatctattatggaacatacttggatgatgaaatattttgccgaattcttcggtacaattattttagttgtatttggaaatggtgctgtagctaactcagttttaactaaaactggtggtaatagccacgatggtcaagcaaacggtggttggttattaatcgccttcagttttgggtttggtgttatgctacctgcaatgatgtttggttcaatttcaggtaaccacttgaatccggcagttacccttgcacaagcttgtgcaggtgcctttccatggaatcaagttttaccttacatcttggttcaaatgttgggagctattgtaggacaattactattagtagcagtatattggccatttatcgcaaaaacatctagcgatgatgcagtttttgcaagtttttctactggtgatattgctgacagcaaattaaacggttttattactgaatttgttggtactgctattcttttatttgtagctgttggtttataccgtggcatgttctttaagcaatcagaagatattgctaatatcggtgttggtttcttgattaccgcacttgttatggccgttggtggtcctacaggtccagcattgaatccggcaagagatttgggtccacgtattgtttatgcactttgtccattgcctcataagggttcagcacattgggattacggttggattccagtcgtagcaccaattgctggtggtatctgcggtgcattattatacaaattagcatttggcttatagaattaaataatataaaaaacaccttcg

SEQ ID NO: 36 - protein, 250 aa, Lactobacillus acidophilus
MEHTWMMKYFAEFFGTIILVVFGNGAVANSVLTKTGGNSHDGQANGGWLLIAFSFGFGVMLPAMMFGSISGNHLNPAVTLAQACAGAFPWNQVLPYILVQMLGAIVGQLLLVAVYWPFIAKTSSDDAVFASFSTGDIADSKLNGFITEFVGTAILLFVAVGLYRGMFFKQSEDIANIGVGFLITALVMAVGGPTGPALNPARDLGPRIVYALCPLPHKGSAHWDYGWIPVVAPIAGGICGALLYKLAFGL

SEQ ID NO: 37 - DNA, 1260 bp, Lactobacillus acidophilus
  CDS (21)..(1199): Putative receptor protein, ORF# 367
ttcatcgtaaggagaaaaatatggttacgatattaataaacgacattataccaattttggtaattatgttgttaggatatgtgtgtggtaaattcacattctttgacgatgatcaacgtcaaggattgaataaactggttttaaacattgctttaccagcggctttatttatttcaattgttaaagctacgcgtaagatgtttgcgcaagatatagttttaacattgatctcattgatcggtgttactggtttattcatgctcagttattatttggataaactgatgtttcacagatcaacgcaagaagctgcggtttgtgcattgattgctggttcaccaactattggatttttgggttttgcggttcttgatccaatttacggaaacaatgcaacaactaacttagttattggaattgtttctattgttgttaatgctgtaactattcctttaggtttgtctttaattaacagaggacaagctgctttaaaggaaaaggcaaaggctaagaagaataatggtggtactgaagtagaagttaaattaccgcaaaaaggtactactgttaagaaggtcaagaaggttactgttcctgatgacgtacctgttagtgatgaagaagctaaagctcttagtgaagttggtattcaacgtgaaattgatttagtccatgcagaatttgatgatcacgccggagaaagcaacggtaaacatatgaatccaactttaaaatcaattcttgatgcgattaagaaaccagttgcagctgctccacttattgcggttatctttgttttgattggaattagagttcctagttcatgggcccctacatttgatttgattgctaaagctaatgctggtgttgctgttttagctgccggtttagctttatcaactgttaaattctcaattgataaagaagttatttggaacacattcttccgtctatttttaactcctgcgattatcgtagctgctgcatatttatgtggtatgggttcagatccacaaaagatttcaatgctttgtttagcaactggtttaccacctgcattttcaggaattattatttccagtcgttacaacatttatgttaaggaaggggcaagttcagttgccgtttcaactgtattctttgcagtaagttgtatcttttggatttgggctttgccacttattgccaacgttttccattaattgaataattagaataagaaacggatctgtaaaacagatccgtttttgtgtgtactta

SEQ ID NO: 38 - protein, 393 aa, Lactobacillus acidophilus
MVTILINDIIPILVIMLLGYVCGKFTFFDDDQRQGLNKLVLNIALPAALFISIVKATRKMFAQDIVLTLISLIGVTGLFMLSYYLDKLMFHRSTQEAAVCALIAGSPTIGFLGFAVLDPIYGNNATTNLVIGIVSIVVNAVTIPLGLSLINRGQAALKEKAKAKKNNGGTEVEVKLPQKGTTVKKVKKVTVPDDVPVSDEEAKALSEVGIQREIDLVHAEFDDHAGESNGKHMNPTLKSILDAIKKPVAAAPLIAVIFVLIGIRVPSSWAPTFDLIAKANAGVAVLAAGLALSTVKFSIDKEVIWNTFFRLFLTPAIIVAAAYLCGMGSDPQKISMLCLATGLPPAFSGIIISSRYNIYVKEGASSVAVSTVFFAVSCIFWIWALPLIANVFH

SEQ ID NO: 39 - DNA, 1020 bp, Lactobacillus acidophilus
  CDS (44)..(982): Alkyl phosphonate ABC transporter (substrate binding), ORF# 151
tttttgtgggcgaatagtttgttttatcactattttatgttttatggaggacataatgaaaagatttagaaaaatcttggtagcagtagttgcacttcttgtagcagtagttgcaacagcttgttcaaataagagtagtagttcaaaggaaaactacactccaaagtcattgaatattcaatttgtaccaagtcaggctgcaactaagttgcaagcccgtgctaagcctcttgaaaagatgctttcaaagagactgggtatcccagttcacgtatctatgtcaactgactacaacactgttgtagaagctatgaagtcaaagaaagttgatgtaggtttccttccaccagatggttacgttttagctcacaagcaaggtgcagctgatttgcttttacaagctgaacgttacggtgttaagcaaccaggtggtaaagcaactaatcaattagttaagaactatcgtgcagaaatccttgttaagaagggttcaaagatcaagaactggaaagatttaaagggtaagtcaatttcagttcaaaacccaacttcaactgctggatacgtattcccagttgctgaacttaaggaaaaaggtttggacgtaactaaggattgtaagttggttactgtaactggtcacgatcaagctgtattgaatgttttaaatggtgatactgatgctgcatttgtatttgaagatgctcgtaacactgttttaaaggacaacccaaagatcatgagtcaagttgttcctatttactttactaagccaattcctaacgatactatctcagtaattccaagcatgtctaagtcattccgtaagaagcttgctaaggcattcatttctgtaggtaagtcaaaggaaggtaagaagattatcgaaagcgtatatagtcacgaaggttatgactacgcaaaggatagtgacttcaacattatccgtaagtatgacaagattgttgaatcaaacaaaaaataattttatcaagggagttaacgattaaatggcagata

SEQ ID NO: 40 - protein, 313 aa, Lactobacillus acidophilus
MEDIMKRFRKILVAVVALLVAVVATACSNKSSSSKENYTPKSLNIQFVPSQAATKLQARAKPLEKMLSKRLGIPVHVSMSTDYNTVVEAMKSKKVDVGFLPPDGYVLAHKQGAADLLLQAERYGVKQPGGKATNQLVKNYRAEILVKKGSKIKNWKDLKGKSISVQNPTSTAGYVFPVAELKEKGLDVTKDCKLVTVTGHDQAVLNVLNGDTDAAFVFEDARNTVLKDNPKIMSQVVPIYFTKPIPNDTISVIPSMSKSFRKKLAKAFISVGKSKEGKKIIESVYSHEGYDYAKDSDFNIIRKYDKIVESNKK

SEQ ID NO: 41 - DNA, 830 bp, Lactobacillus acidophilus
  CDS (41)..(811): Alkyl phosphonate ABC transporter ATP binding protein, ORF# 152
tcaaacaaaaaataattttatcaagggagttaacgattaaatggcagataagccaatgatccaattaaaagatgtttctaagatttatgacaatggaactgtcggcttaaaagacatcaacttaaaaattaataaaggcgaattcgtagtagtagttggtttgtctggtgcggggaagtcaactttacttcgttcaattaatcgtctacatgatatttcttcaggcgatattttaattgatggtaagtcaattacaaacgctaagggtaaaaatttgcgcgaattacgtcgtgatattggaatgattttccaaaactttaacttagttaagcgctctagcgtattacgtaacgttttagtaggtagagttgcttattacccaacttggaagactacttttaacttgtttaccaaagaagataagcaaaaagcttatgaagcacttcaaaaagttgatttggcagataaggtatacgcacgtgcagatgaattatcaggaggtcaacaacaacgtgtggccattgctcgtgtgttaatgcaaaatcctaagatcattttggctgatgaaccaacagcttcacttgatcctcagacttcagttagagttatgaatgacttgaagatgcttaatgaaaaatatggcatgactgtagttgctaacttgcacagtatcgaacttgctcaacaatttggtaagcgagtaatcggtattcgtgcaggacaagtagtttacgatggtaagatggaagacactcctaagtcagtatttaccgatatttataacggtggcgacggtaatgagggggcagaataatgcctgaaaatcaaga

SEQ ID NO: 42 - protein, 257 aa, Lactobacillus acidophilus
MADKPMIQLKDVSKIYDNGTVGLKDINLKINKGEFVVVVGLSGAGKSTLLRSINRLHDISSGDILIDGKSITNAKGKNLRELRRDIGMIFQNFNLVKRSSVLRNVLVGRVAYYPTWKTTFNLFTKEDKQKAYEALQKVDLADKVYARADELSGGQQQRVAIARVLMQNPKIILADEPTASLDPQTSVRVMNDLKMLNEKYGMTVVANLHSIELAQQFGKRVIGIRAGQVVYDGKMEDTPKSVFTDIYNGGDGNEGAE

SEQ ID NO: 43 - DNA, 840 bp, Lactobacillus acidophilus
  CDS (14)..(808): Alkyl phosphonate ABC transporter permease, ORF# 153
agggggcagaataatgcctgaaaatcaagatttaatgcatttgcctaagcgtaaattcaaagttatgaacttagtttggacaatcattatggttgcaggattattcatttcaattaatgtcactaatactcatatcagtgttttatttgaaaactgggatcagtttgcggacatctttgttcaaatgtcacatccagactggagctacatgagtgttatctggcccaaattaattgaaacgattaagatggctgtattaggtacagtaatcggttctgcagttgcctttgtttattcattattgattgctcgtaatattgttaagaataaggctgtaactggtgtgctcagatttataatgaacatcatcagaacaattcctgaccttttacttggtgctatctttgttgccattgtgggtattggtcctgttgccggtattatggtcttggctgtatttacttttggtgtggttgtaaagcttttctatgaagcaattgaaactattgatccaggtccaattgaagcattaactgctgtaggtgcaaataaattccaaattattcactatgcagttatgcctcagattatgacttacttcatttcctatgttttatatgcatttgaaatcaatgtaagagcatcaacagttcttggttatatcggtgccggtggtattggtcttaacttgcaacaaactttgcaagtcttcaattacgcccaaaccggtacaattatcatcgttatcatcgtagtcgttgtattgattgactatgtatcatctaagtcacgggaggcattaatgaaataatgaatacaactatgaaaaaattacctgct

SEQ ID NO: 44 - protein, 265 aa, Lactobacillus acidophilus
MPENQDLMHLPKRKFKVMNLVWTIIMVAGLFISINVTNTHISVLFENWDQFADIFVQMSHPDWSYMSVIWPKLIETIKMAVLGTVIGSAVAFVYSLLIARNIVKNKAVTGVLRFIMNIIRTIPDLLLGAIFVAIVGIGPVAGIMVLAVFTFGVVVKLFYEAIETIDPGPIEALTAVGANKFQIIHYAVMPQIMTYFISYVLYAFEINVRASTVLGYIGAGGIGLNLQQTLQVFNYAQTGTIIIVIIVVVVLIDYVSSKSREALMK

SEQ ID NO: 45 - DNA, 900 bp, Lactobacillus acidophilus
  CDS (31)..(840): Alkyl phosphonate ABC transporter permease, ORF# 154
atctaagtcacgggaggcattaatgaaataatgaatacaactatgaaaaaattacctgctaaacccgttgaccgtaagaagcaagtcactcattggttagttgcaatttgtaccatcgttattattatttggtcatttaccggtattaattttggtggtattaaggcaactgctggtcaaattgctggagcaattttcgctggtattttccatccagattggagttatatttataacggctctggtgaagatcttatttcacagttgtggcaaactatttgtatcgcattcttaggtacatttatttctgcaattatttcattgccatttgctttctgggcagctcatactaagcataagcattggtatacttctagaatcggtaaaattgttttggcaattattagatcattcccagaaattgttttagctttgatgtttattaaagctgtaggacctggttctgctgccggtgtattggcattaggtttccactcagtggggatgcttgctaagctattctcagaagcaattgaaaacttggaagaaggaccaaatgaagcagttgttgctgcaggtggctctaagttccacgtaattatgttttcaactatgcctaacttaatgccagcacttatttcaaatactttgtatcgttttgatgtttcaatccgttctgcatctatccttggtttggtaggtgccggtggtattggttacccattgatcattgcacttcaatatcgtcaatgggatcgagtaggtattatcttacttggtatcatcattatggtagtaattattgactggatttctggttggatccgtaagaagttagtttaatttttaaattcccaataaataagcaaggacattgtccttgcttatttttatgctctg

SEQ ID NO: 46 - protein, 270 aa, Lactobacillus acidophilus
MNTTMKKLPAKPVDRKKQVTHWLVAICTIVIIIWSFTGINFGGIKATAGQIAGAIFAGIFHPDWSYIYNGSGEDLISQLWQTICIAFLGTFISAIISLPFAFWAAHTKHKHWYTSRIGKIVLAIIRSFPEIVLALMFIKAVGPGSAAGVLALGFHSVGMLAKLFSEAIENLEEGPNEAVVAAGGSKFHVIMFSTMPNLMPALISNTLYRFDVSIRSASILGLVGAGGIGYPLIIALQYRQWDRVGIILLGIIIMVVIIDWISGWIRKKLV

SEQ ID NO: 47 - DNA, 1380 bp, Lactobacillus acidophilus
  CDS (46)..(1350): Conserved hypothetical protein, ORF# 1952
gcttttttaaataaaaaacacgaacaattctttggagagagatttatgaattttattaaaaattattttcaactagataaataccatactagtgttaaagttgaatttattgctggtttgactacttttattagtatgtcttacattttatttgttaaccctagcgttttaggtgctagcggcatgaacaccggtgctgtatttactgcaaccgccttagccagtgctcttggtactgccattatgggtatcgttgctaattacccgattggtgaggcaccagcactgggtatcaatgccttttttgcttacactgtttgtgtgggaatgcacgtttcttggcaaacagctttagccagcgtattcgttgcatcaattattttcattttaatcactttatttaagttacgtgaaaagattattgattcaattccagctgacttgaagtttgctatttcatcaggtattggtttatttattgcctttttaggattacaaaacggtaaattaatcgtcgcaaataaatcaactttggttggcttaggctcacttcacgatccacttgtttggatcaccatctttggtttgcttgtgactgttatcttgatgattttaggcgttcctggtgccatctttattggtatggttttggcagccgtctttggtatttgtactggtcaaatttcattgccacacaaggttatctcaacagctccaagtttggcacctacttttggtcaagctatcttccatgttaaggatattaattctgttcaaatgtgggttgttgtattaacattcttgcttgttactttctttgatactgctggtactttgatcggacttgcccaacaagccggctttatgaaaaataataagatgccacgtgttggtaaggcattggctgccgactcaagtgcgatggccgttggttcaattttgggtacctcaccagttggtgcatacgttgaatcaagtgctggtattgccgttggtggtagaactggtttgactgccgtctttgtagcaatcttcttcttgatctcaatgatcttcagtccacttttgggtgtattcaccagtcaagttactgcaccagctttgattatcgttggtgtcttgatggcacaaaatactgctcacattcactggaataaattggaaattgcggttcctgcattcctgattattttggggatgccgcttacctactcaatttctgatggtttgtcatgggggatgattacttacccaatctgcatgcttgcagctaaacgtggtaaagaagttagcccgatgatgtgggtattattcgttgtattcatcatcttcttgtgggtactgaacttttaactaaaaagaatattaaaaaaggactaa

SEQ ID NO: 48 - protein, 435 aa, Lactobacillus acidophilus
MNFIKNYFQLDKYHTSVKVEFIAGLTTFISMSYILFVNPSVLGASGMNTGAVFTATALASALGTAIMGIVANYPIGEAPALGINAFFAYTVCVGMHVSWQTALASVFVASIIFILITLFKLREKIIDSIPADLKFAISSGIGLFIAFLGLQNGKLIVANKSTLVGLGSLHDPLVWITIFGLLVTVILMILGVPGAIFIGMVLAAVFGICTGQISLPHKVISTAPSLAPTFGQAIFHVKDINSVQMWVVVLTFLLVTFFDTAGTLIGLAQQAGFMKNNKMPRVGKALAADSSAMAVGSILGTSPVGAYVESSAGIAVGGRTGLTAVFVAIFFLISMIFSPLLGVFTSQVTAPALIIVGVLMAQNTAHIHWNKLEIAVPAFLIILGMPLTYSISDGLSWGMITYPICMLAAKRGKEVSPMMWVLFVVFIIFLWVLNF

SEQ ID NO: 49 - DNA, 2100 bp, Lactobacillus acidophilus
  CDS (68)..(2068): Trehalose PTS, ORF# 1012
tatagacaagtaaagcataatttaagttactataaagtaaatattgtgatcgctttcaaaaaatatattgacaacttgtatatacaagtttaatataatagctaaatctaatgaaaacgctttatacaggagaaaaacaatgaatgaaaacaatgaaattgcaattctcgctcccgcaagcggtgaagtaattgcattaagtaaaacaagtgatccaatctttagtaaaggtgcaatgggacaaggatttggtcttacaccatctgatggtgaagttgttgcaccaataagtggaaaagtttcaatgattgcagatactaaacatgctattggaataaccacagatgatgggcttgaagtattagttcacatgggagttgatacagttagtcttaagggagagccttttgaagttttagttaaaaatggtcaaactattgaagccgggcaagatattgccacaatgaatcttaaagccattaaaagtagcaatcttgatactaccattatggttttaatcacaaactcaaatgataagcttgagggtttagacgtttctgaaggtcctgctagaactggcgacgttatagctcatgcatacctaaaagtagaacaaaagaatacctcaaatcaaaagctttcatatgatgaactggcaacttttatcataaaaaatgttgggggcaaagataatattaacaatttaattcactgtatcactcgtctacgcttctacttgaaagatgaaagtaaagctaatgacgaagcattaaagaatcaacgtggtattcttgatgttatgcatgctggtggtcaatatcaagttgttatcggaaatgaagttactaatgtttatgatgcagtaatgaaacagcttcctaatttaagtgatcaacctgctccacaaactaatgaaaatgatgaccgtaatcctgtttcaaaggcatttggcaacttgatcggctttattactggttcaatgagtccagtaattggcgtaatcgctgcatcaggtattattaaaggatttttggctttactcactcttccacaacttggagcattattaaacgttaaaagtcctgtctatataacagttagtgcaatggctgactcagcattcttcttcctaccaattttagttggattctcggctgctaaacgacttaatagtgatccaattattgcagctgtaattggtggttttattacttatccccaaatgattagttggggtactgcgggtaagatgatgtttaatctaggtaattggaacttccaattcttaaactacagttactcaatctttccaatgatcttggctgcatggcttgctgctaaatgcgaagattggcttaagaaaattttaccaagctatttacaaatgattttcgtaccattaattactattttagctgtatcaaccatcactttagtaattacggggccagttattcaaggtgctgctaacggcatcgcagtatttattaattggttagtatcatcatcaggttggatcggcggcttagtaatcggtgccttttaccaactacttgttatcttcggtcttcactggggtgttgtaccactggtcgctcaacaaattgcttctactggtcaaagttcattaaatgcaattatttgttcaactatgatcgctcaaggtgctgccgttttagctgttgcagttaagtcaaagaaggctgacatgaaagaattaggtattgcagctgctatctcagcattctgcggtgttaccgaaccagcgatttatggaattaacttaagatacaagaaagtttttgcttcaggctgtgtcggttcagcatttggtggtcttgtaaccggtcttatgcatggtacaatgtacggttttactggtggtctaattggattttctagtttcttcaatccggctcatcctactcaactaaacagtttctacacattcttaatcgctagtgctgtttctattgtggttgcattcattgttacctgggtttggggctataatgataatatgaccatgggtaaaaaagttgaaaagaaacaacgtccaggtactaagtaaaaattctaattatcatcataataaaaaga

SEQ ID NO: 50 - protein, 667 aa, Lactobacillus acidophilus
MTTCIYKFNIIAKSNENALYRRKTMNENNEIAILAPASGEVIALSKTSDPIFSKGAMGQGFGLTPSDGEVVAPISGKVSMIADTKHAIGITTDDGLEVLVHMGVDTVSLKGEPFEVLVKNGQTIEAGQDIATMNLKAIKSSNLDTTIMVLITNSNDKLEGLDVSEGPARTGDVIAHAYLKVEQKNTSNQKLSYDELATFIIKNVGGKDNINNLIHCITRLRFYLKDESKANDEALKNQRGILDVMHAGGQYQVVIGNEVTNVYDAVMKQLPNLSDQPAPQTNENDDRNPVSKAFGNLIGFITGSMSPVIGVIAASGIIKGFLALLTLPQLGALLNVKSPVYITVSAMADSAFFFLPILVGFSAAKRLNSDPIIAAVIGGFITYPQMISWGTAGKMMFNLGNWNFQFLNYSYSIFPMILAAWLAAKCEDWLKKILPSYLQMIFVPLITILAVSTITLVITGPVIQGAANGIAVFINWLVSSSGWIGGLVIGAFYQLLVIFGLHWGVVPLVAQQIASTGQSSLNAIICSTMIAQGAAVLAVAVKSKKADMKELGIAAAISAFCGVTEPAIYGINLRYKKVFASGCVGSAFGGLVTGLMHGTMYGFTGGLIGFSSFFNPAHPTQLNSFYTFLIASAVSIVVAFIVTWVWGYNDNMTMGKKVEKKQRPGTK

SEQ ID NO: 51 - DNA, 780 bp, Lactobacillus acidophilus
  CDS (44)..(766): Trehalose repressor, ORF# 1013
catttatgaatataataaatgtacaaagaaaggaaagacataaatgacggaatcaaaatcagacattattgcacaagatattgctgctaaaatacagcatcaacaatttaaagctggtgagttacttccaagtgagagtcaattaacaacactatatggtacatctcgcgagacagttcgtaaggcgttgaatcaattaactgcgttgggtctaatacaaaaaatacgtggaaaaggttcaatagttttaaatttagaaaaatattcttttcctatttctggaattactagtttcgctgaattgaataaatctttaaacatgcatgcagaaacaaaagtaatcacattaaaaaagatggttgatttaccagaattttttaaggaaaaatttccagagcaaaaaaggcaaccaggaatctatgttgaaagattgcgtgtagttaataatgagcctgtcgtattagattgtgattatttgttttcaccaccaattgatgaattaccaaaagaggcagcagaaaaatctatttatgattatattgaaaataaacttaaattagatatttcatatgctacaaaggtaattacagttgaaaaaattgatgataaatttaaaaagttattacaactggatgatagtttagctgtattagtagccagtcataatttcttgaatgacactacgttattccaattgacattatctttccataatccaagtaaatttaaatttgttgattttgcaagaagacagaagattaaattgtaaggagaaaagta

SEQ ID NO: 52 - protein, 241 aa, Lactobacillus acidophilus
MTESKSDIIAQDIAAKIQHQQFKAGELLPSESQLTTLYGTSRETVRKALNQLTALGLIQKIRGKGSIVLNLEKYSFPISGITSFAELNKSLNMHAETKVITLKKMVDLPEFFKEKFPEQKRQPGIYVERLRVVNNEPVVLDCDYLFSPPIDELPKEAAEKSIYDYIENKLKLDISYATKVITVEKIDDKFKKLLQLDDSLAVLVASHNFLNDTTLFQLTLSFHNPSKFKFVDFARRQKIKL

SEQ ID NO: 53 - DNA, 1740 bp, Lactobacillus acidophilus
  CDS (12)..(1721): Trehalose-6P hydrolase, ORF# 1014
taaatttaaatttgttgattttgcaagaagacagaagattaaattgtaaggagaaaagtatgattaatttaggcaaaaaaataatttatcaaatttatcctaaatctttctatgattcaaatggcgatggggtaggagatcttcaaggaatcattcaaaagattgattatattaagaagttaaatgtagacatgatctggtttaatccattttttgtttcaccgcaaaatgataatggttatgatattgctgattattacaacattgatcctcgctttggtacaatggctgattttgagaaattggtaaagaagctgaaagaaatcggtgtgggtgtaatgctagatatggtgctcaatcactgctcaactgaaaatatttggtttaaaaaagcacttgctggcaatgaaaagtatcgtaaatttttctacttgagaaaaggaaaaaacggaggtttacctaataattggcaaagtaaattcggtggtactgcttggtcaaaatttggtgataccgattactactaccttcacttgtatgatccaactcaagcagatcttgattggcataatcctgaagttcgtaaagaattatttaaagtggttaacttttggcgtagtaaaggtgtccatggcttccgctttgatgtaattaatgttacgggtaaagcggaaaaactagttgattcaacagatcctgtagaagaaaagagtttgtacactgatactccaattgttcataaatacttaaaagagcttaatgctgcaacttttggtcaagaccctgaatcaattactgtgggagaaatgtcatcaacgacgattgccaactcaattgaatattcaaaaccaagtgaacatgaattatcaatggttttcactttccatcatttgaaagttgactatcaggatggtgaaaagtggtctaagatgccatttgattttatgaaattaaaggaattattcactgaatggcaagaaaaaatggatcaaggtgatggctggaacgcattattctgggacaatcatgatcagccttgggcattaactagatttggtgatactggtaagtatcgtggaaagtcagctgaaatgcttgccacagcaactcatcttatgcggggaacaccatatatttatatgggtgaagaaattggtatgattgatcctgattattcttcaatggatgattacgtagatgttgaggccaagaatgcttttaaggctttaactaaaaaaggtttgagtgataaagaagcttttgaaatagttaaatcaaaagctcgtgacaattcacgtgtaccaatgcattggaatagtgaaaaatatgcaggttttagtgaacataagccgtggctcataccaactgatcaagaaaaaattaatgttgaagaggaattagcacatggtgaaatttttaattactatcaaaagttaattaagctgcgtagaagcgaagatttaatctctgatggtcatattaagatgttcttgaaagatgatccgcaggtttttgcttatgaacgctacttaaaagatagtgataaaaagttattggtatttactaacttctatggtaaagaacatagtgttaaattacccgaagaatatcaaaacaaagaataccaagttttaattaacaattatgatactaaagatagccaattaaccgatgaaattatattgaagccatatgaagcattagctattaaaattaaacaataagatagaaaaaagtagt

SEQ ID NO: 54 - protein, 570 aa, Lactobacillus acidophilus
MLILQEDRRLNCKEKSMINLGKKIIYQIYPKSFYDSNGDGVGDLQGIIQKIDYIKKLNVDMIWFNPFFVSPQNDNGYDIADYYNIDPRFGTMADFEKLVKKLKEIGVGVMLDMVLNHCSTENIWFKKALAGNEKYRKFFYLRKGKNGGLPNNWQSKFGGTAWSKFGDTDYYYLHLYDPTQADLDWHNPEVRKELFKVVNFWRSKGVHGFRFDVINVTGKAEKLVDSTDPVEEKSLYTDTPIVHKYLKELNAATFGQDPESITVGEMSSTTIANSIEYSKPSEHELSMVFTFHHLKVDYQDGEKWSKMPFDFMKLKELFTEWQEKMDQGDGWNALFWDNHDQPWALTRFGDTGKYRGKSAEMLATATHLMRGTPYIYMGEEIGMIDPDYSSMDDYVDVEAKNAFKALTKKGLSDKEAFEIVKSKARDNSRVPMHWNSEKYAGFSEHKPWLIPTDQEKINVEEELAHGEIFNYYQKLIKLRRSEDLISDGHIKMFLKDDPQVFAYERYLKDSDKKLLVFTNFYGKEHSVKLPEEYQNKEYQVLINNYDTKDSQLTDEIILKPYEALAIKIKQ

SEQ ID NO: 55 - DNA, 900 bp, Lactobacillus acidophilus
  CDS (60)..(866): Mannose PTS, ORF# 455
taaataaagctcagcacttacttgatgaacaaaagaaataaattaataggagtaaataaatgaacgctatacaaatgattttggtagtggccgttgcctttcttgcaggtacagaaggtatcttggatgaatggcaattccaccaaccattagttgcatgtacattaattggtttagtaacaggccatttggacttaggtgttatcttaggtggtcaattacaaatgatcgctttaggttgggcaaatattggtgccgctgttgcaccagatgccgctttagcatcagttgcttcagctattatcttggttgaaggtggtcaaggtgttaagggtatcggtactgctactggtattgctattcctttagctgttgctggtttgttcttaactatgattgtacgtactatttcaactgctatcgttcacgttatggacgcagaagctaagaagggtaactggcgtatgatcaacttgtggcaatggattgctgtatgtttgcaaggtttgagaatcgctatcccagctgctcttcttttggcaattccttcagaaactgttaaaggttggcttgcaatgatgccacaatggttatcagaaggtatgaccatcggtggtggtatggttgttgctgtaggttatgctatggttattaacatgatggcaagtaaagaagtatggccattcttcgcaatcggttttgctttagctgctatcaaggacttaactttgatcgctcttggtgctatcggtctttcaatggctttgatgtacttagctcttgaatcaaaaggtggcaacggcggttcaaacaactctggttctgctggtaccggcgatccactcggcgatatcattgatgattattaaaatgaacgcgtagaggaggatttataaaatg

SEQ ID NO: 56 - protein, 269 aa, Lactobacillus acidophilus
MNAIQMILVVAVAFLAGTEGILDEWQFHQPLVACTLIGLVTGHLDLGVILGGQLQMIALGWANIGAAVAPDAALASVASAIILVEGGQGVKGIGTATGIAIPLAVAGLFLTMIVRTISTAIVHVMDAEAKKGNWRMINLWQWIAVCLQGLRIAIPAALLLAIPSETVKGWLAMMPQWLSEGMTIGGGMVVAVGYAMVINMMASKEVWPFFAIGFALAAIKDLTLIALGAIGLSMALMYLALESKGGNGGSNNSGSAGTGDPLGDIIDDY

SEQ ID NO: 57 - DNA, 1020 bp, Lactobacillus acidophilus
  CDS (58)..(978): Mannose PTS, ORF# 456
cactcggcgatatcattgatgattattaaaatgaacgcgtagaggaggatttataaaatggctgataaaaagaaaattgaattaaccaagcgtgaccgttttaacgttatgtggcactcacaattccttcagggttcatggaactatgaaagaatgcagaatggtggtttcgcttactcaatgattcctgctttgagaaagttatacccagacaagaaagatttgtctgctgctatgcaaagacacttagtattctttaacacccacccatacttggcatctcctgtacttggtgttactttggctttggaacaagataaagctaacggtacaccagttactgatgatgctatccaaggtgttaaggttggtatgatgggacctttggctggtgttggtgaccctgtattctggtacactgttcgtccgattgttggtgctttaggtgcatcaatggccatcgcaggtaacgttatgggacctatcttattcttcgttatctggaatgtaatcagacttgcattcttatggtatacacaagaatttggttacaaggctggttcagctatcactaacgacatgtccggtggtatgcttcaaaaagttacccgtggtgcttcaatgatgggtatgttcgtcttgggtgccttgattgaacgttgggtaaacattaagtttacaccaatagtttcacaaacacctatccaaaaaggtggatatattgaatgggacaagcttccatcaggtgctaaaggtattcaatctgcccttgaacaatggaacatgggtaatggtaaggctttaactagtactaaggttactactttacaagacaacttggatcaattgattcctggtattgctggtcttcttttaacattcttctgtatgtggttgttaaagaagaaggtttcaccaatctggattattattggtatcttcgttgttggtgtattgttccacgtatggcacattctttaataaaaaatggctaaatcaattaatacgaaagtcgatctg

SEQ ID NO: 58 - protein, 307 aa, Lactobacillus acidophilus
MADKKKIELTKRDRFNVMWHSQFLQGSWNYERMQNGGFAYSMIPALRKLYPDKKDLSAAMQRHLVFFNTHPYLASPVLGVTLALEQDKANGTPVTDDAIQGVKVGMMGPLAGVGDPVFWYTVRPIVGALGASMAIAGNVMGPILFFVIWNVIRLAFLWYTQEFGYKAGSAITNDMSGGMLQKVTRGASMMGMFVLGALIERWVNIKFTPIVSQTPIQKGGYIEWDKLPSGAKGIQSALEQWNMGNGKALTSTKVTTLQDNLDQLIPGIAGLLLTFFCMWLLKKKVSPIWIIIGIFVVGVLFHVWHIL

SEQ ID NO: 59 - DNA, 1380 bp, Lactobacillus acidophilus
  CDS (57)..(1352): Glycerol 3P ABC transporter, ORF# 585
gtttatgttaaacttctctttgtaggaaagaaattgagaggcaaaagaaaaatagaatgaaattttataaaaagctcgcactcgttagtacagcaacaatcggtttaatcagccttagcgcttgttcaaacaatagtaataattcaagttctacaaagattccaactaaaattactaagaagactactattaacttctggtattcattaactggaacttcacaaaacgctttgaaaaaattgactaaggattttgaaaagaaaaatcctaatatcaatattaagttgcaaagccaaggtggtaactattctgatttacaagcaaagcttgtttcaggcttgcaatcacctaaggacttgccaactattacgcaagcttatccaggttggctttacaacgcagctaagaataatatgctggttaacttaactccatatgttaacaacaaaacaattggctggggctcatacaaggatagcggcattaagcaagctctttgggatggagccaagatcaacggtactcaatatggtgtcccattcaacaagtcagttgaagtactcttctacaacaagaccttacttgataagtatggcgtaaaggtgcctactaacatgagtcaacttgctagtgcttctgctgaaatctaccgtaagagtaaccacaaggtacgtggtgctggctttgacgcacttaacaactactacatgatgcaaatgaaggaaacttatggcaaggacttcaacaagaacgtcaactttgctgctaaggattccgttaaggcaatcaactactatgcagagggcgttaaggctggttacttcatgcaagctggtacgcaaaagtacatgtcaactccattcaacaatggtcaagttgccatgttcatcggttcaactgctaatgaagcttaccttaagcaaggacttaagaagggctatgtttatggtgtagctgctcgtccaagttcaatgaatgttcaacaaggtactgacatctacatgttcaagaaggctagtgcaatgcaaaaggctgctgcattcaagtaccttaagttcttgacttctaagtcttcccaactttactgggcaaagcaaactggttacatgccagttaacactgccgctttgaatgattcagcttaccaaaaggctaagaacagcaagattcctgcaattttgtctaagacttcaaagaatttatacttcttacctgtaactaagaactcaattactgcatatgatcaagttaatgtgaatatgcaaaacattttggctaaggcaagcaagggtcaaaactggaccagcgatattaaatctggcaaggctaaacttgacgcttcttggaagcaataaaaatttatttagataattaaaaggc

SEQ ID NO: 60 - protein, 432 aa, Lactobacillus acidophilus
MKFYKKLALVSTATIGLISLSACSNNSNNSSSTKIPTKITKKTTINFWYSLTGTSQNALKKLTKDFEKKNPNINIKLQSQGGNYSDLQAKLVSGLQSPKDLPTITQAYPGWLYNAAKNNMLVNLTPYVNNKTIGWGSYKDSGIKQALWDGAKINGTQYGVPFNKSVEVLFYNKTLLDKYGVKVPTNMSQLASASAEIYRKSNHKVRGAGFDALNNYYMMQMKETYGKDFNKNVNFAAKDSVKAINYYAEGVKAGYFMQAGTQKYMSTPFNNGQVAMFIGSTANEAYLKQGLKKGYVYGVAARPSSMNVQQGTDIYMFKKASAMQKAAAFKYLKFLTSKSSQLYWAKQTGYMPVNTAALNDSAYQKAKNSKIPAILSKTSKNLYFLPVTKNSITAYDQVNVNMQNILAKASKGQNWTSDIKSGKAKLDASWKQ

SEQ ID NO: 61 - DNA, 480 bp, Lactobacillus acidophilus
  CDS (65)..(469): 30S ribosomal protein, ORF# 287
tcgcgagtataaaaagaaactcccggatgtgtgaacaaaatagtatttttaggaggaaaaattaatgccaaccattaatcaattggtaagaaaaggccgtcattcaaaggttactaaatcaaaatcacctgctttgaattacagctacaacagtatgaagaaggaatcagtattcaacccagctccacaaatgcgtggtgttgcaactcgtgttggtaccatgactccaaagaagcctaactcagctttacgtaagtacgctcgtgtacgtctttcaaacttgatcgaagttactgcttacattccaggggaaggccacaacttgcaagaacactcagttgttttaatccgtggtggtcgtgtaaaggaccttcctggtgtacgttaccatatcgttcgtggtgcccttgatactgctggtgttgaaggcagaaagcaaagccgttctaagtacggtactaagaaagattaaaggaggag

SEQ ID NO: 62 - protein, 135 aa, Lactobacillus acidophilus
MPTINQLVRKGRHSKVTKSKSPALNYSYNSMKKESVFNPAPQMRGVATRVGTMTPKKPNSALRKYARVRLSNLIEVTAYIPGEGHNLQEHSVVLIRGGRVKDLPGVRYHIVRGALDTAGVEGRKQSRSKYGTKKD

SEQ ID NO: 63 - DNA, 1332 bp, Lactobacillus acidophilus
  CDS (1)..(1332): slpA, ORF# 169
atgaagaaaaatttaagaatcgttagcgctgctgctgctgctttacttgctgttgctccagttgctgcttctgctgtatctactgttagcgctgctactactattaacgcaagttcatcagcaatcaataccaacactaatgctaagtacgatgttgatgtaactcctagtgtttctgcagttgctgcaaatactgctaacaacactccagctattgccggtaaccttactggtactatttcagcaagttacaatggtaagacttatactgctaacttaaaggcagatactgaaaatgccactattactgctgctggtagcactactgccgttaaacctgctgaattagctgcaggtgtggcttacactgtaactgttaacgatgtttcatttaacttcggttcagaaaatgcaggtaagactgttacccttggttcagctaactcaaatgtaaaattcaccggtacaaacagtgataatcaaactgaaactaatgtttctactttgaaagttaagttagaccaaaacggtgttgcttcacttactaatgtttcaattgcaaacgtatacgcaattaacactactgataacagtaacgtaaacttctacgacgtaactagtggtgctactgtaactaacggtgccgtttcagttaatgctgataaccaaggtcaagttaatgttgcaaacgtagttgcagcaattaattcaaaatactttgcagcacaatacgcagataagaagttaaatactcgtactgctaatactgaagatgctattaaggcagccttaaaggaccaaaagattgatgtaaactcagtaggttacttcaaagcacctcatactttcactgttaacgttaaagcaacttcaaatactaatggtaagtcagctactttgccagtagttgttactgttcctaatgttgctgagccaactgtagccagcgtaagcaagagaattatgcacaacgcatactactacgacaaggacgctaagcgtgttggtactgacagcgttaagcgttacaactcagtaagcgtattgccaaacactactactatcaacggtaagacttactaccaagtagttgaaaacggtaaggctgttgacaagtacatcaacgctgcaaacatcgatggtactaagcgtactttgaagcacaacgcttacgtttacgcatcatcaaagaagcgtgctaacaaggttgtattgaagaagggtgaagttgtaactacttacggtgcttcatacacattcaagaacggccaaaagtactacaagatcggtgacaacactgacaagacttacgttaaggttgcaaactttaga

SEQ ID NO: 64 - protein, 444 aa, Lactobacillus acidophilus
MKKNLRIVSAAAAALLAVAPVAASAVSTVSAATTINASSSAINTNTNAKYDVDVTPSVSAVAANTANNTPAIAGNLTGTISASYNGKTYTANLKADTENATITAAGSTTAVKPAELAAGVAYTVTVNDVSFNFGSENAGKTVTLGSANSNVKFTGTNSDNQTETNVSTLKVKLDQNGVASLTNVSIANVYAINTTDNSNVNFYDVTSGATVTNGAVSVNADNQGQVNVANVVAAINSKYFAAQYADKKLNTRTANTEDAIKAALKDQKIDVNSVGYFKAPHTFTVNVKATSNTNGKSATLPVVVTVPNVAEPTVASVSKRIMHNAYYYDKDAKRVGTDSVKRYNSVSVLPNTTTINGKTYYQVVENGKAVDKYINAANIDGTKRTLKHNAYVYASSKKRANKVVLKKGEVVTTYGASYTFKNGQKYYKIGDNTDKTYVKVANFR

SEQ ID NO: 65 - DNA, 1299 bp, Lactobacillus acidophilus
  CDS (1)..(1299): phosphoglycerate dehydratase, ORF# 889
ttgaggaggtttataatgctcaaatcagttattgaaaatgtacacgcactcgaaatttttgactcacgtggtaacccaactgttgaagttcacgttactctttcaaacggtgtcgtaggtaaggctgaagttccatcaggtgcttcaactggtgaaaacgaagctgttgaattacgtgacggtggttcacgtcttggtggtaagggtgtttcaaaggctgttaacaatgttaacactgaaattaacgacgctttaaagggtatggacccatttgaccaacctaagattgaccaaactatgatcgacttagatggtactccaaacaagggccgtcttggtgctaacgctatcttaggtgtatcaatggctactgctgttgctgcagctaacgctaaccgtcaacctctttaccgttaccttggcggtattgatcttgaaatgccacaaactttccacaacgttatcaacggtggtgaacacgctgacaacggtatcgacattcaagaattcatgattactccaattgctaagacttcattccgtgatggtttcgaaaagatcgttaacgtataccacactttgaagaaggttcttgaagacatgggttacgaaactggcttgggtgacgaaggtggtttcgcacctaacatgaagaactcagaagaagctttgaaggctttacacgaatcaatcatcaaggctggttacaagccaggtgaagatatcggtatcgcatgtgactgtgctgcttcatacttctacaacaaggaagatggtaagtaccaccttgaaggtaaggttcttactgatgatgaattagctgcatactacgacaagcttttggatgaattcccagaattaatgtcaatggaagacccatacgacgaaaacgatgttgaaggtatggttaagtttactgcaactcacaaggaccgtatccaaatcgttcttgacgacttcatttgtactaacccagcacttttgaagaaggctatcaaggaaggtgcaggtaacgcttcattaatcaagttgaaccaaattggtactgttactgaaactcttgaaactatccgtatgtcacgtaagaatggttacaacactatgatttcacaccgttcaggtgaaactggtgacacattcatcgctgacttggcagttgctataaacggtggtcaacttaagaccggtgctccagctcgttcagaacgtgttgaaaagtacaaccgcttacttgaaatcgaagaagaacttggcaagggcgaacgtcttgcattcttcccagatgatgttgaccacgat

SEQ ID NO: 66 - protein, 433 aa, Lactobacillus acidophilus
MRRFIMLKSVIENVHALEIFDSRGNPTVEVHVTLSNGVVGKAEVPSGASTGENEAVELRDGGSRLGGKGVSKAVNNVNTEINDALKGMDPFDQPKIDQTMIDLDGTPNKGRLGANAILGVSMATAVAAANANRQPLYRYLGGIDLEMPQTFHNVINGGEHADNGIDIQEFMITPIAKTSFRDGFEKIVNVYHTLKKVLEDMGYETGLGDEGGFAPNMKNSEEALKALHESIIKAGYKPGEDIGIACDCAASYFYNKEDGKYHLEGKVLTDDELAAYYDKLLDEFPELMSMEDPYDENDVEGMVKFTATHKDRIQIVLDDFICTNPALLKKAIKEGAGNASLIKLNQIGTVTETLETIRMSRKNGYNTMISHRSGETGDTFIADLAVAINGGQLKTGAPARSERVEKYNRLLEIEEELGKGERLAFFPDDVDHD

SEQ ID NO: 67 - DNA, 1215 bp, Lactobacillus acidophilus
  CDS (1)..(1215): elongation factor, ORF# 845
ttgcaaatttacaggagggtcattttaatggcagaaaaagaacattacgttagaactaagccacacgtaaacattggtactatcggtcacgttgaccacggtaagaccactttaactgcggctattactactgttttagctgaaaagggattagctaaggctgaagattactcacaaatcgatgctgcacctgaagaaaaggaacgtggtatcactattaacaccgcccacgtagaatacgaaactgaaaatcgtcactacgctcacatggacgctccaggccacgccgactacatcaagaacatgattaccggtgcggctcaaatggatggtgctatcttagttgttgctgcaactgatggtcctatgccacaaactcgtgaacacattttgcttgctcgtcaagttggtgttaactacatcgtagtattcttgaacaagtgcgatttagttgacgacccagaattgatcgacttggttgaaatggaagttcgtgacttgttgactgaatacgattaccctggtgatgatattccagttgttcgtggttcagcattaaaggctttacaaggtgacaaggaagctcaagaccaaatcatgaagttgatggacattgttgatgaatacatcccaactccagaacgtcaaactgacaagccattcttgatgccagttgaagacgtattcactatcactggtcgtggtactgttgcttcaggtcgtatcgaccgtggtactgttaaggtcggtgacgaagttgaaatcgttggtttggtagataaagttcttaagtcagttgttactggtttggaaatgttccacaagactttggacttaggtgaagccggcgataacgttggtgtattgcttcgtggtgttgaccgtgatcaagttgttcgtggtcaagtattggctgcacccggctcaatccaaactcataagaagtttaaggcacaagtttatgttttgaagaaggacgaaggtggtcgtcacactccattcttctcagactaccgtccacaattctacttccacaccactgatattactggtgaaattgaattgccagaaggtactgaaatggttatgcctggtgataacactgaattcactgttactttgatcaagccagctgccatcgaaaagggtactaagttcaccatccgtgaaggtggtcgtaccgttggtgccggtcaagttactgaaatccttgac

SEQ ID NO: 68 - protein, 405 aa, Lactobacillus acidophilus
MQIYRRVILMAEKEHYVRTKPHVNIGTIGHVDHGKTTLTAAITTVLAEKGLAKAEDYSQIDAAPEEKERGITINTAHVEYETENRHYAHMDAPGHADYIKNMITGAAQMDGAILVVAATDGPMPQTREHILLARQVGVNYIVVFLNKCDLVDDPELIDLVEMEVRDLLTEYDYPGDDIPVVRGSALKALQGDKEAQDQIMKLMDIVDEYIPTPERQTDKPFLMPVEDVFTITGRGTVASGRIDRGTVKVGDEVEIVGLVDKVLKSVVTGLEMFHKTLDLGEAGDNVGVLLRGVDRDQVVRGQVLAAPGSIQTHKKFKAQVYVLKKDEGGRHTPFFSDYRPQFYFHTTDITGEIELPEGTEMVMPGDNTEFTVTLIKPAAIEKGTKFTIREGGRTVGAGQVTEILD

SEQ ID NO: 69 - DNA, 1767 bp, Lactobacillus acidophilus
  CDS (1)..(1767): pyruvate kinase, ORF# 957
atgaagaaaactaagattgttagtactttaggaccagcttcaaacgatattgaaactattactgctttagctaacgcaggcgcaaacgtattccgtttcaacttctcacacggtgaccatgaagaacaccgttcacgtatgaacatggttcgtgaagtggaaaagaatactggtaagcttcttggtattgctcttgatactaagggtgctgaaatcagaaccactgaacaagaaggtggcaagtttactatcaatactggtgacacaatccgtatctcaatggacgatactaagaagggtaacaaggacatgatccacgttacctacgacggcttgtacgatgatactcacgttggtggtcacgtattaatcgatgatggtttggttgaccttttgatcaaggaaaaggacgacgctaagagagaattagtttgtgaagctcaaaacactggtttaatcggttcaaagaagggtgttaacgctccaggtgttgaaattcgcctcccaggtatcactcaaaaagatactgatgacattaactttggtttgaaggaaggtatcaactttatctttgcttcattcgcacgtaaggctcaagatatcttagacatccgtaagctttgtgaagcagcaggtgctgactacgtaaagattttccctaagatcgaatcacaagaaggtatcgacaacgctgacgaaattttacaagtttctgatggtttgatggttgctcgtggtgacatgggtgttgaaattccatttatggaagttccatttgtacaaaagaacttaatcagaaaagctaacgcacttggtaagccagttattactgctactcaaatgcttgactcaatgcaagaaaacccacgtccaactcgtgctgaagtttctgacgttgctaacgctgttcttgacggtactgatgcaactatgctttcaggtgaatcagcaaacggtttgtacccagttaacgctgttaaagctatggctgaaatcgatgaacgtactgaaaagcaaatgcttaagcgtaacactttagcacttcaaagatttgaagcatacaagggctcaaacgtaactgaagctatcggtgaatcagttgtacgtactgcacaagaattaggtgttaagactatcatcgctgcaactaactcaggttacactgctcgtatgatttctaagtaccgtccaaatgctgacatcgttgcaatgaccttcgatgaaaagatccaacactcattggcagttgtttggggtgtacaaccagtattaactgacaagcctaagtcaactgatgacatgtttgaaaaggcagcagaagttgctaaggaaaagggctacgttaaggatggtgaccttgtaattatcgttgctggtgttccagttggtgattcaggtactactaacttgatgaagttacaaattatcggtaacaagcttgttcaaggtttaggtgttggtaacggttcagttatcggcaaggctgttgttgcaaactcagcagaagaagctaacagcaaggttaaggaaggcgacatcttagttgctaagactactgatccagactacaacccagctatcaagaaggcttcaggtttggttgttgaagcttcaggtttaacttcacacgcagcagttattggtttatcattaggtatcccagttgttgttggtgctactgacgctactgaaaagatttctgacggttcaactattactgttgatgctcgtcgtggtgctatttaccaaggtgaaatctcaaacctt

SEQ ID NO: 70 - protein, 589 aa, Lactobacillus acidophilus
MKKTKIVSTLGPASNDIETITALANAGANVFRFNFSHGDHEEHRSRMNMVREVEKNTGKLLGIALDTKGAEIRTTEQEGGKFTINTGDTIRISMDDTKKGNKDMIHVTYDGLYDDTHVGGHVLIDDGLVDLLIKEKDDAKRELVCEAQNTGLIGSKKGVNAPGVEIRLPGITQKDTDDINFGLKEGINFIFASFARKAQDILDIRKLCEAAGADYVKIFPKIESQEGIDNADEILQVSDGLMVARGDMGVEIPFMEVPFVQKNLIRKANALGKPVITATQMLDSMQENPRPTRAEVSDVANAVLDGTDATMLSGESANGLYPVNAVKAMAEIDERTEKQMLKRNTLALQRFEAYKGSNVTEAIGESVVRTAQELGVKTIIAATNSGYTARMISKYRPNADIVAMTFDEKIQHSLAVVWGVQPVLTDKPKSTDDMFEKAAEVAKEKGYVKDGDLVIIVAGVPVGDSGTTNLMKLQIIGNKLVQGLGVGNGSVIGKAVVANSAEEANSKVKEGDILVAKTTDPDYNPAIKKASGLVVEASGLTSHAAVIGLSLGIPVVVGATDATEKISDGSTITVDARRGAIYQGEISNL

SEQ ID NO: 71 - DNA, 1995 bp, Lactobacillus acidophilus
  CDS (1)..(1995): fructose PTS, ORF# 1777
atgagaattaaggacattctaagccctgaatccatgatcatggaactcaaggctaccaacaaagaagatgccattaaagaaatggcagatcttgaagtggcaaccgatgttgttaatgatgaagatgcatttatcaagtctatctgggctcgtgaaaatgaatcaactaccggtatcggtggcggaattgcaatgccacacgcacgtaacaagtcaattaacaaggctcgtgtattgtttgctaagagtaaggaaggtattgactacgactcacttgatggtcaaccagttcacttattcttcatgattactgcaccagaaggtgctgataatactcaccttcaagctttagctaaactttcaggtttattgattgatcctgaattggttgaaaaacttaaggctactaagactcctgaagaagttattgatctttttgaaaaggctgaagctaagaaggacgaagaagacaagaaagctgctgaagccagaaaagctaaggaagctgctaaggctcaaggctcaagcgatgatgacaacaagccattaatcgttggtgttactgcatgtatcaacgggattgcccacacttacatggctcaagaagccttgattaaagaaggtaagaagcgtggcattgaagttagaattgaaactaacggttctgaaggtgttaaagacaagcttactccagatgaaatcaagcgtgctaagggtgttatcattgcttccgataagaaggttgacatgccacgttttgatggtaagcctttagttaaccacccagttgttgatggtattaacaagccgggtgaattgattgatgatattatggacggtaaggcagatacttaccatgctagtgcagctgacaagtcagaagaatcatcaagtactgaaaagccaggcttatgggcaagtatttataagaacttgatgagtggtattagccacatgcttccattcgttatcggtggtggtatcttaatggctatctccttcatcgtagaaaactacggtggtggtgcaaagactcctgcatttatcttcttgaacaacgcaggtaacttggcctttgccttcatggttccagttctttcagcttacattgctgaatcaatcggcgacttaccagcattaatgccaggttttgttggtggttacatggcttctattgctaatggtcaattccaagttaacgttcaagcccatgcaacttcaccagctggattcttaggtggtattgctgccggtttcattgctggttacttaatgatcggtttaaagaaggcctttgctaaattacctcgttcagttgaaggtatgaagccaatgttgttctatccaatcttaggattgctctttattgcagcaattatgttctacatcattaacccaatctttagtggtgtaaactttgcaattactcacttcttgaacagtatgggtactggtaacttggtacttcttactactatcttggcaggtatgatgtcaatcgatatgggtggtcctttcaacaaggctgcatatgtctttgcttcaggtgcatttgctaacgacccacactcaactactgctgctattttgatggctgccgtaatggttggtggtatggttcctccatttgctactgctattggtactacattcttcaagaacaagtacactatggaagaacgtcgtgcaggtgtttctaactgggtattaggattctcattcattactgaaggtgctattccatttgccgcagctgacccaggtcgtgtaattccttcatgtatcattggttcagctgtaggtggtgccttagttggtttatggcacgttggtgttcctgctcctcacggtggtctttgggtatcaccacttgcaggtaacattggtggacctatgcacattttgttctacttcttagcaactattattggttcaatcgtagcaggtttgatcatgagtttctggaagaagaacgttaaagatgatcctaacgaa

SEQ ID NO: 72 - protein, 665 aa, Lactobacillus acidophilus
MRIKDILSPESMIMELKATNKEDAIKEMADLEVATDVVNDEDAFIKSIWARENESTTGIGGGIAMPHARNKSINKARVLFAKSKEGIDYDSLDGQPVHLFFMITAPEGADNTHLQALAKLSGLLIDPELVEKLKATKTPEEVIDLFEKAEAKKDEEDKKAAEARKAKEAAKAQGSSDDDNKPLIVGVTACINGIAHTYMAQEALIKEGKKRGIEVRIETNGSEGVKDKLTPDEIKRAKGVIIASDKKVDMPRFDGKPLVNHPVVDGINKPGELIDDIMDGKADTYHASAADKSEESSSTEKPGLWASIYKNLMSGISHMLPFVIGGGILMAISFIVENYGGGAKTPAFIFLNNAGNLAFAFMVPVLSAYIAESIGDLPALMPGFVGGYMASIANGQFQVNVQAHATSPAGFLGGIAAGFIAGYLMIGLKKAFAKLPRSVEGMKPMLFYPILGLLFIAAIMFYIINPIFSGVNFAITHFLNSMGTGNLVLLTTILAGMMSIDMGGPFNKAAYVFASGAFANDPHSTTAAILMAAVMVGGMVPPFATAIGTTFFKNKYTMEERRAGVSNWVLGFSFITEGAIPFAAADPGRVIPSCIIGSAVGGALVGLWHVGVPAPHGGLWVSPLAGNIGGPMHILFYFLATIIGSIVAGLIMSFWKKNVKDDPNE

SEQ ID NO: 73 - DNA, 912 bp, Lactobacillus acidophilus
  CDS (1)..(912): fructose 1P kinase, ORF# 1778
atgatttatacagtaactgttaacccagctcttgactatgttcttcaattagaaaaagttaaccgcggggaagttaacagaactaacaatgattcatttttagcagggggtaaaggaattaacgtttctcaaatccttaaccaattaaatgttgacaacactgcatggggctttgttggcggctttaccggtaaggaattggttcgtcaattaaaccaaaagagaattgaaagtgacttcgttactatttcagataatactcgtgtgaacgttaagatccatgcagaaaaggaaactgaaattaatgcagcaggtcctgccattactaaccaagaaatcgttgctttcaaagatcgcttgaacgacttgaagaagggcgacatcgtagtaatgagcggttcacttactccaagtcttcctactgatttctaccaatcacttcttccaactattaaggaagctggtgcagaatttgtagttgatactactggtcaagcacttcttgatactttggaatatcacccattagtaattaagcctaaccatcacgaattggctgatttgtttggcgtaacatttgaatcaagtgatgacatgcttaagtacgcaaagaagcttcttgacatgggtgctcaaaatgtaatgatttcaatggctggcgaaggcggtttccttttgactaaggatcatgtatatcatgcaaagggtgctgtaggtactgctgttaactctgttggcgctggtgactcaatgattgctgggttcgttggtacttactacaagactcaagatccaaaagaaggatttagaattggtatggcctgtggtgctgctactgcatttactaaagatattgcggttaagagccaaatcgatgcagtattaccacaaattaaggttgaacaaatttct

SEQ ID NO: 74 - protein, 304 aa, Lactobacillus acidophilus
MIYTVTVNPALDYVLQLEKVNRGEVNRTNNDSFLAGGKGINVSQILNQLNVDNTAWGFVGGFTGKELVRQLNQKRIESDFVTISDNTRVNVKIHAEKETEINAAGPAITNQEIVAFKDRLNDLKKGDIVVMSGSLTPSLPTDFYQSLLPTIKEAGAEFVVDTTGQALLDTLEYHPLVIKPNHHELADLFGVTFESSDDMLKYAKKLLDMGAQNVMISMAGEGGFLLTKDHVYHAKGAVGTAVNSVGAGDSMIAGFVGTYYKTQDPKEGFRIGMACGAATAFTKDIAVKSQIDAVLPQIKVEQIS

SEQ ID NO: 75 - DNA, 969 bp, Lactobacillus acidophilus
  CDS (1)..(969): L-lactate dehydrogenase, ORF# 271
atggcaagagttgaaaaacctcgtaaagttattttagttggtgacggtgctgtaggttctacctttgcattttcaatggtgcaacaaggtattgctgaagaattaggtatcattgatattgctaaggaacacgttgaaggtgacgcaatcgacttagcagatgctactccatggactttcccaaagaacatttacgcagctgactacgctgactgcaaggacgcagacttagtagttattactgctggtgctccacaaaagccaggtgaaactcgtcttgaccttgttaacaagaacttgaagattttatcatcaatcgttgaaccagttgttgaatcaggctttgaaggtatcttcttagtagttgctaacccagttgacatcttgactcacgcaacttggaagatttcaggcttccctaaggatcgcgttattggttcaggtacttcacttgatactggtcgtcttcaaaaggttatcggtaagatggaacacgttgacccacgttcagttaatgcatacatgcttggtgaacacggtgatactgaattcccagtatggagctacaacaatgttggtggcgtaaaggttagcgactgggttaaggctcacggtatggatgaatctaagcttgaagaaatccacaaggaagttgctgacatggcttacgacattatcaacaagaagggtgctactttctacggtatcggtacagcttcagcaatgatcgctaaggctatcttgaacgatgaacaccgtgtacttccactctcagttgcaatggatggtcaatacggtttacacgaccttcacattggtactcctgcagttgttggccgtaacggtcttgaacaaattattgaaatgcctttaaccgctgatgaacaagctaagatggaagcttctgctaagcaattaaaggaagttatggacaaagcctttgaagaaactggcgttaaggttcgtcaa

SEQ ID NO: 76 - protein, 323 aa, Lactobacillus acidophilus
MARVEKPRKVILVGDGAVGSTFAFSMVQQGIAEELGIIDIAKEHVEGDAIDLADATPWTFPKNIYAADYADCKDADLVVITAGAPQKPGETRLDLVNKNLKILSSIVEPVVESGFEGIFLVVANPVDILTHATWKISGFPKDRVIGSGTSLDTGRLQKVIGKMEHVDPRSVNAYMLGEHGDTEFPVWSYNNVGGVKVSDWVKAHGMDESKLEEIHKEVADMAYDIINKKGATFYGIGTASAMIAKAILNDEHRVLPLSVAMDGQYGLHDLHIGTPAVVGRNGLEQIIEMPLTADEQAKMEASAKQLKEVMDKAFEETGVKVRQ

SEQ ID NO: 77 - DNA, 909 bp, Lactobacillus acidophilus
  CDS (1)..(909): fructose biP aldolase, ORF# 1599
atggcttattttgtaaatggtaacgaaatcttcagagaagctcgtaaacaccactacgctgtaggtgcttacaacactaacaacttggaatggactcgtgcagaattacgtgctgcagaagaaactagaactccacttttgatccaagtttcaactggtgctgctaagtacatgggtggctataagttcgttaaggacatggttgaagaccaaatggactcaatgaacatctctgttccagttatcttaaacttggaccacggtgactttgaatcagctaaggaatgtattgcacttggttactcatcagttatgtttgatggtcacgcacttccaactgaagaaaacttggctaagactaaggaaattatcaagttggctcacgaacgcggtatttctgttgaagctgaaattggtaagatcggtgaaaaccaaggcggcggtgaattagcttctgttgaagatgctaaggcattcgttgaagctggtgttgacaagcttgcttgtggtattggtaacatccacggtgtttacccagcagactggaagggtcttaacttcgatcgtttgaaggaaattgctgaagctgttcctgaaactccacttgtacttcacggtggttcaggtattcctgaagaccaaatcaagaaggctatccaacttggtatttcaaaggttaacatcaacactgaattccaattagcattccaagaagcaactcgtaagtacatcgaagaaggcaaggacgaagacaaggctaacaagggttacgacccacgtaagttgttattgccaggtactgaagcaatcactgacaagatgaaggaaatgattgcttggttaggtactaagactatcgatgacgaacttaaggatgctttattcgaccgttcatcattgaacgaagaa

SEQ ID NO: 78 - protein, 303 aa, Lactobacillus acidophilus
MAYFVNGNEIFREARKHHYAVGAYNTNNLEWTRAELRAAEETRTPLLIQVSTGAAKYMGGYKFVKDMVEDQMDSMNISVPVILNLDHGDFESAKECIALGYSSVMFDGHALPTEENLAKTKEIIKLAHERGISVEAEIGKIGENQGGGELASVEDAKAFVEAGVDKLACGIGNIHGVYPADWKGLNFDRLKEIAEAVPETPLVLHGGSGIPEDQIKKAIQLGISKVNINTEFQLAFQEATRKYIEEGKDEDKANKGYDPRKLLLPGTEAITDKMKEMIAWLGTKTIDDELKDALFDRSSLNEE

SEQ ID NO: 79 - DNA, 753 bp, Lactobacillus acidophilus
  CDS (1)..(753): fructose operon regulator, ORF# 1779
atgctgacacaagaacgccaaagcttaattgaagactacgttaatcagcacgaattgtgccgcgttagcgaattatgcaatttaactgatacatctgaatcaactatccgacgtgatttgattcaaatggagaaaaatggcatcctcaagcgagttcatggcggtgctcaatcagtaaaaaatttctctcgtgatgtttcccaaaacgtccgctttagtctgaatcatgatgttaagattgctattgctaaatatgcggcagagcatttcgttcatccaggtgataatgtctttattgatgcaggaacgacaacctatgaaatggtcccatttctggcagaaattcctaatgttaagattatcaccaacggagttgaaactgctctttgcagcttgaatcatggcattaagactttcttaattggtggcgaggtcaaagatgatactcatgctgttgttggtcagactgctttaagtcagattagagcaatgaatttttcagctagctttgttggagctaatgggattgaaaagaatggcaacttaactacgccagatcctgaagaagctgcaattaaagcagctgagattaaacaagctagacatgcatatgttttagctgatagtactaaaattggcgaacgaaattttgctgtttttgctaatactgatgacgttattgtggtaacagaaaagattaaatccagtcaaaaaacggcattacctgccgatataaatctagaggaggcaaaa

SEQ ID NO: 80 - protein, 251 aa, Lactobacillus acidophilus
MLTQERQSLIEDYVNQHELCRVSELCNLTDTSESTIRRDLIQMEKNGILKRVHGGAQSVKNFSRDVSQNVRFSLNHDVKIAIAKYAAEHFVHPGDNVFIDAGTTTYEMVPFLAEIPNVKIITNGVETALCSLNHGIKTFLIGGEVKDDTHAVVGQTALSQIRAMNFSASFVGANGIEKNGNLTTPDPEEAAIKAAEIKQARHAYVLADSTKIGERNFAVFANTDDVIVVTEKIKSSQKTALPADINLEEAK

SEQ ID NO: 81 - DNA, 744 bp, Lactobacillus acidophilus
  CDS (1)..(744): 50S Protein, ORF# 360
gtgggagagttaagagaagctcgtttgaccacatatacaaggaggaattcacacatgccaaagcatggtaagaaatatttagatgctgccaagaaggtagactcaaataaattatactcagtagcagaagctatgaaacttgttaaggaaacttcatacgcaaactttgacgctactattgatgtagcttacaacttgagcgtagatcctaagcaagcagaccaacaaattcgtggttcaattgttttgccaaacggtactggtaagacccaaactgttgtagtatttgctgaaggcccacaagctgaacaagctaaggctgcaggcgctgattttgttggttcagacgacttggtagaaaagattcaaggcggctggttagactttgatgttgtagttgcaactccaatgatgatggctaaggttggtcgtttaggtcgtgtacttggacctaagggattgatgccaaaccctaagactggtactgtaactatggacattgaaaaggctgttaagaacgttaaggcaggtcaagtagaataccgtgttgaccgtcaagcagctatccacactcctattggtaaggtatcatttactgaagaccaattagtagaaaactttgatgctttacgtgacgtaattttacgtgctcgtccagcatcagctaagggtcaatacattaagagtgttgctgtttcagcaacctttggacctggtatcaagcttgatccattaaacttagac

SEQ ID NO: 82 - protein, 248 aa, Lactobacillus acidophilus
MGELREARLTTYTRRNSHMPKHGKKYLDAAKKVDSNKLYSVAEAMKLVKETSYANFDATIDVAYNLSVDPKQADQQIRGSIVLPNGTGKTQTVVVFAEGPQAEQAKAAGADFVGSDDLVEKIQGGWLDFDVVVATPMMMAKVGRLGRVLGPKGLMPNPKTGTVTMDIEKAVKNVKAGQVEYRVDRQAAIHTPIGKVSFTEDQLVENFDALRDVILRARPASAKGQYIKSVAVSATFGPGIKLDPLNLD

SEQ ID NO: 83 - DNA, 1047 bp, Lactobacillus acidophilus
  CDS (1)..(1047): D-lactate dehydrogenase, ORF# 55
atggtcatactaataaattttacggaggttaaatttatgacaaagatttttgcttacgctattcgtaaagacgaagaaccattcttaaacgaatggaaggaagctcacaaagatatcgatgttgattacactgataaacttttgactcctgaaactgcaaagcttgctgaaggtgcagacggtgttgttgtttaccaacaattagactacactcctgaaacccttcaagcattggcagatgctggcgtaactaagatgtcattacgtaacgttggtgtcgataacatcgacatggacaaggccaaagaattaggctttgaaatcactaatgttcctgtttactcaccagacgctattgctgaacatgctgctattcaagctgcacgtgtattacgtcaagacaagcgcatggacgaaaagatggctaaacgtgatttacgttgggcaccaactatcggccgtgaagttcgtgaccaagttgtcggtgttgttggtactggtcacattggtcaagtatttatgaagattatggaaggctttggcgcaaaagttattgcttacgatatcttcaagaaccctgaacttgaaaagaagggttactacgttgattcacttgatgacttgtacaagcaagctgatgtaatttcacttcacgtaccagacgttccagctaacgtacacatgattaacgatgaatcaatcgccaaaatgaaggatggcgttgtaatcgtaaactgctcacgtggtccacttgttgacactgatgcagtaattcgtggtttagactcaggcaagatcttcggcttcgttatggatacttacgaaggcgaagttggtgtatttaacaaggactgggaaggtaaagaattcccagacgaacgcttggcagacttaattgatcgtccaaacgtattggtaaccccacacactgccttctacactactcacgctgtacgtaacatggttgttaaggcatttgacaacaacttggaattaatcaagggcgaaaaaccagattctccagttgctttggacaagaacaagttc

SEQ ID NO: 84 - protein, 349 aa, Lactobacillus acidophilus
MVILINFTEVKFMTKIFAYAIRKDEEPFLNEWKEAHKDIDVDYTDKLLTPETAKLAEGADGVVVYQQLDYTPETLQALADAGVTKMSLRNVGVDNIDMDKAKELGFEITNVPVYSPDAIAEHAAIQAARVLRQDKRMDEKMAKRDLRWAPTIGREVRDQVVGVVGTGHIGQVFMKIMEGFGAKVIAYDIFKNPELEKKGYYVDSLDDLYKQADVISLHVPDVPANVHMINDESIAKMKDGVVIVNCSRGPLVDTDAVIRGLDSGKIFGFVMDTYEGEVGVFNKDWEGKEFPDERLADLIDRPNVLVTPHTAFYTTHAVRNMVVKAFDNNLELIKGEKPDSPVALDKNKF

SEQ ID NO: 85 - DNA, 1371 bp, Lactobacillus acidophilus
  CDS (1)..(1371): slpB, ORF# 175
atgaagaaaaatttaagaatcgttagcgctgctgctgctgctttacttgctgttgctccagttgctgcttctgctgtatctactgttaacgctgccgctgttaatgctattgctgttggcggttcagctaccccattaccaaacaactcagatgtacaaattagttcatcagttgctggtgtaactactaagaatggctcaagctacactaacggtagaatttctggttctatcaacgcttcttacaacggtacaagctattcagcaaactttagttcatcaaatgcaggtgttgttgtttcaactccaggccatactgaacttagtggtgaacaaattaacggtcttgaaccaggtagtgctgtaactgttactttaagagatggtgtttcatttaactttggttcaactaatgctaacaagactattactttagcatttccaaagaacgtatcagctgctggtttagctgatgctaacaaggtttcagctacttcagaaacttcagttgatgcaggcaagactatccaagttaagactgacaagaacggtgttgtaagcttcggttcagcacaagttcttaacgttaaggttgttgaaactagcgacgttagagctgtttcattctacgacatccaaactggtaagactgtagaaaacggtactctttcaatcgttgctggttctaacgcacgtgctaacgtacaagaaatcgttaacgcatttaacgctaagtaccaagcttctcaattgaacaacgctaacagcaatgctaacgttcgtttgactgacaacaacgctcaagctgttgctactatgttaagagctcaaaacattgatgttgatgcacaaggttacttcactgcaccagcttcattgagcttaactttccacgcagaatcaactcaaaacaatgaaactgcacaattaccagtaactgtttcagtaactaacggtaaggaagttactccttcaactgtagacagcgtaagcaagagaattatgcacaatgcatactactacgacaaggacgctaagcgtgttggtactgacagcgttaagcgttacaactcagtaagcgtattgccaaacactactactatcaacggtaaggcttactaccaagtagttgaaaacggcaaggcagttgacaagtacatcaacgctgcaaacatcgatggtactaagcgtactttgaagcacaacgcttacgtttacgcatcatcaaagaaacgtgctaacaaggttgtattgaagaagggtgaagttgtaactacttacggtgcttcatacacattcaagaacggccaaaagtactacaagatcggtgacaacactgacaagacttacgttaaggttgcaaactttaga

SEQ ID NO: 86 - protein, 457 aa, Lactobacillus acidophilus
MKKNLRIVSAAAAALLAVAPVAASAVSTVNAAAVNAIAVGGSATPLPNNSDVQISSSVAGVTTKNGSSYTNGRISGSINASYNGTSYSANFSSSNAGVVVSTPGHTELSGEQINGLEPGSAVTVTLRDGVSFNFGSTNANKTITLAFPKNVSAAGLADANKVSATSETSVDAGKTIQVKTDKNGVVSFGSAQVLNVKVVETSDVRAVSFYDIQTGKTVENGTLSIVAGSNARANVQEIVNAFNAKYQASQLNNANSNANVRLTDNNAQAVATMLRAQNIDVDAQGYFTAPASLSLTFHAESTQNNETAQLPVTVSVTNGKEVTPSTVDSVSKRIMHNAYYYDKDAKRVGTDSVKRYNSVSVLPNTTTINGKAYYQVVENGKAVDKYINAANIDGTKRTLKHNAYVYASSKKRANKVVLKKGEVVTTYGASYTFKNGQKYYKIGDNTDKTYVKVANFR

SEQ ID NO: 87 - DNA, 1731 bp, Lactobacillus acidophilus
  CDS (1)..(1731): enzyme I for CCR, ORF# 640
atgaccaagactttaaaaggaattgctgctagtgatggtattgccattgctccagcatatcttcttgtggagcctgatctttcattctcaaagtcttcagtcgacgacattgatgctgaagtagcacgttataacgatgctattaaggaatcaactgccgaagttgaaaaaattcgtgatattgctaagaagagcttgggtgaagaagaatcccaagtttttgaagcacacttaatgattttgaacgatccagaatttactggtgcaattgagaatgaaattaaggattcaaagattaatgcagaagctgcccttgatgaaactgcacaaaagtttattgctatttttgaagggatgactgataatccttatatgcaagaacgtgcagctgatgtacgtgatgtttcaaagcgtattatggctcacttacttggtaaagaattaccaaacccagcttcaattgatcacgaagttattgttgtagcacatgacttgactccaagtgatactgcacaacttaacaagaaatacgttaaaggctttattactgatgttggtggtcgtaccgctcactcagcaattatggctcgttcacttgaattgccagctgttgttggtactgattcaatcaccaaagacgttaaaaacggcgacatgttaattgatgacggtcttgacggtgtagctattatttcaccaagtgaagaacaaatagctgactacaagaaaaagggtgaagacttccttaagcaaaaggctgaatggaagaagttaaaggatgaaccatcagtaactgcagatggtaagcaatttattattgctgcaaacatcggtactcctaacgatatgccaggtgtacatgaaaacggtgctgaagctattggtttgtacagaactgaatttttgtacatggattcatcagacttcccaactgaagatgatcaattcgaagcctacaagaaagttattgaaggtatgaacggcaagcaagttgttatcagaactatggatattggtggtgataagcaccttgattactgggatttaccagaagaaatgaatccattcttaggtgtacgtgctattcgtctttcacttatgaatgaagaaattttccgtacccaattaagagccttactccgtgcttccgcatatggtaagcttggtattatgttcccaatggttggtacattagctgaacttcgtaaggctaaggctattttaaacgatgaaaagcaaaaacttgttgaaaagggagttaagatcggtgacaacttacaagttggtatgatgatcgaagttcctgctgcagctgttttggctgatcaatttgctaaagaagttgatttcttctcaatcggtactaatgacttgatccaatatactatggctgctgaccgtggtaatgataacgtatcatacttgtaccaaccatataacccatcagtacttcgtttgattaagcacactattgatgctgctcatgaaaatggtatttggtgtggtatgtgtggtgaagctgctggtgataacaccatgttcccaattttactttcaatgggacttgatgaatactcaatgagcgcaacttcaatcttacgtattagaagcttaatgaagaagcttgataccaaagatcttaaggaattagctaatgaagcttgttttgtttcagaaactgctgaagaaaacgaaaaattagttaacgacttaatgaagaaaattaacaag

SEQ ID NO: 88 - protein, 577 aa, Lactobacillus acidophilus
MTKTLKGIAASDGIAIAPAYLLVEPDLSFSKSSVDDIDAEVARYNDAIKESTAEVEKIRDIAKKSLGEEESQVFEAHLMILNDPEFTGAIENEIKDSKINAEAALDETAQKFIAIFEGMTDNPYMQERAADVRDVSKRIMAHLLGKELPNPASIDHEVIVVAHDLTPSDTAQLNKKYVKGFITDVGGRTAHSAIMARSLELPAVVGTDSITKDVKNGDMLIDDGLDGVAIISPSEEQIADYKKKGEDFLKQKAEWKKLKDEPSVTADGKQFIIAANIGTPNDMPGVHENGAEAIGLYRTEFLYMDSSDFPTEDDQFEAYKKVIEGMNGKQVVIRTMDIGGDKHLDYWDLPEEMNPFLGVRAIRLSLMNEEIFRTQLRALLRASAYGKLGIMFPMVGTLAELRKAKAILNDEKQKLVEKGVKIGDNLQVGMMIEVPAAAVLADQFAKEVDFFSIGTNDLIQYTMAADRGNDNVSYLYQPYNPSVLRLIKHTIDAAHENGIWCGMCGEAAGDNTMFPILLSMGLDEYSMSATSILRIRSLMKKLDTKDLKELANEACFVSETAEENEKLVNDLMKKINK

SEQ ID NO: 89 - DNA, 690 bp, Lactobacillus acidophilus
  CDS (1)..(690): phosphoglycerate mutase, ORF# 185
atgtcaaaattagttttaatccgtcacggtcaaagtgaatggaacctttcaaaccaatttactggttgggttgacgttaacctttcagaaaaaggtgttgaagaagctaagaaggctggtcgtttaatcaaggaacacggtcttgaatttgatcaagcttacacttcattattaactcgtgctatcaagactttgcactacgcattggaagaaagtgaccaactttggattccagaaactaagacttggagacttaacgaacgtcactacggtgctcttcaaggcttgaacaagaaggctactgctgaaaagtacggtgatgaacaagttcacatttggcgtcgttcatacgatgttttgccaccagctattgacgatgacaacgaatttagtcaagcacatgaccgtcgttacgcaaacttggatccacacatcgttcctaaggcagaaaacttacacgtaactttggatcgtgtaatgccattctgggaagataacattgctccagacttacttgacggtaagaacgtaattattgctgcacacggtaactcacttcgtgctttgactaagtacattgaaaacatttctgacgatgacatcatggacctcgaaatgaagactggtgaaccagttgtttacactttcgacgaaaacttggatgttgttaacaaggaaaagttggacgac

SEQ ID NO: 90 - protein, 230 aa, Lactobacillus acidophilus
MSKLVLIRHGQSEWNLSNQFTGWVDVNLSEKGVEEAKKAGRLIKEHGLEFDQAYTSLLTRAIKTLHYALEESDQLWIPETKTWRLNERHYGALQGLNKKATAEKYGDEQVHIWRRSYDVLPPAIDDDNEFSQAHDRRYANLDPHIVPKAENLHVTLDRVMPFWEDNIAPDLLDGKNVIIAAHGNSLRALTKYIENISDDDIMDLEMKTGEPVVYTFDENLDVVNKEKLDD

SEQ ID NO: 91 - DNA, 960 bp, Lactobacillus acidophilus
  CDS (1)..(960): phosphofructokinase, ORF# 956
atgaaacggattggtattttaactagtggtggagacgcccctggtatgaatgcagcaattagagctgtgacaaagactgctatccatcatggacttgaagtctttgggattcgttatggtttcgctggtttggttgcaggtgactttattccgcttactacggaaaatgttgaccacaagattagtgaaggcggtactttcttgtacagtgctcgcttccctgaatttgcacaagaagaagtgcaacaaaagggtgttgagcaactaaagaaacatggtattgatgctgttatcgttattggcggtgatggatcatatcatggtgctttagccttaactcgccacggcgtaaactcagttggtttaccaggaactatcgataatgatattccttatactgactacacgatcggctttgattctgcttgtcgtactgctatggatgcgattgacaagattcgcgacacagcaagtagtcaccaccgcgtattcgttgttaatgtaatgggtcgtgaatgtggtgatattgctatgcgtgtaggtgtagctagtggagcagatgcaattgttattcctgaacgtccttatgacgtaaaggaaattgcagaaactattaaacgtggttttgcagatggcaaagatcatggtatcattgtcttggcagaaggcgttatggatgccgaagaatttaaggatgaattacttaaatacggtgattttgatgctcgtgctaatgttcttgcacatatgcaacgtggtggctcaccaactgttgaagatagagtaaatgctactaagatgggtaactatgctgttaacttacttcttgatgggaagggcggtttagctgtcggcatggagaatggtaagttgaatacccacgacattttagatctatttgacagtaagcaccaaggcgacttttcactgctagatgttaatgaagaaatgactaaagat

SEQ ID NO: 92 - protein, 320 aa, Lactobacillus acidophilus
MKRIGILTSGGDAPGMNAAIRAVTKTAIHHGLEVFGIRYGFAGLVAGDFIPLTTENVDHKISEGGTFLYSARFPEFAQEEVQQKGVEQLKKHGIDAVIVIGGDGSYHGALALTRHGVNSVGLPGTIDNDIPYTDYTIGFDSACRTAMDAIDKIRDTASSHHRVFVVNVMGRECGDIAMRVGVASGADAIVIPERPYDVKEIAETIKRGFADGKDHGIIVLAEGVMDAEEFKDELLKYGDFDARANVLAHMQRGGSPTVEDRVNATKMGNYAVNLLLDGKGGLAVGMENGKLNTHDILDLFDSKHQGDFSLLDVNEEMTKD

SEQ ID NO: 93 - DNA, 888 bp, Lactobacillus acidophilus
  CDS (1)..(888): hypothetical protein, ORF# 958
atgcttggaactattgcaaaaggaaaaataattgataaaaatgataaagcttactatgttcaaatagatggcattacttatgagcttaagaagcatgaaattactcaagacgatattcccaaaattggtgatgtggttgaaggatttatttatgataataaagatcatgatcgtgaaatgacacaatttttaccttttgctcaaccagatcaatatgggtgggggaaagtgaccgaagttcgtccgggattaggtgtatttgttgatgtaggtcttccagataaggatgtagttgtttcaatggatgatttaccacgagaaaaagaaagatggccacgtcgtgatgatcagcttttagtacgattggaaactgattataaagatcgtatttgggcaaaattggctgatgaagatatttttgatcaattagcagctaatttcccacgtggtatgaataatcaaaatgtttttggtacagtttatgctagtcgtgatatcggtgcttttgtattaactaatgattattatcttggttttatccatgaatcacaaatgccaagaccgatgagacttggagaacaatttaaaggtcgagtaattggtgttagccaatatggacgtttgaatttaagtgcattaccacgtgcatttgaagaaattgatgatgatgcgcaaatgattttaatgagtttacgtagaagagaaactaaaacattgccattttatgacaaatctgatgctcaagagattaaagcttactttggaatttctaaatcagcatttaagagagcattaggtcatttacttaaagctggtttgattgaagaagataaggatgctggtactattactttgattaaggatccagaagagaatactgatgacgaa

SEQ ID NO: 94 - protein, 296 aa, Lactobacillus acidophilus
MLGTIAKGKIIDKNDKAYYVQIDGITYELKKHEITQDDIPKIGDVVEGFIYDNKDHDREMTQFLPFAQPDQYGWGKVTEVRPGLGVFVDVGLPDKDVVVSMDDLPREKERWPRRDDQLLVRLETDYKDRIWAKLADEDIFDQLAANFPRGMNNQNVFGTVYASRDIGAFVLTNDYYLGFIHESQMPRPMRLGEQFKGRVIGVSQYGRLNLSALPRAFEEIDDDAQMILMSLRRRETKTLPFYDKSDAQEIKAYFGISKSAFKRALGHLLKAGLIEEDKDAGTITLIKDPEENTDDE

SEQ ID NO: 95 - DNA, 2091 bp, Lactobacillus acidophilus
  CDS (1)..(2091): ribosomal Protein, ORF# 289
atggctaacaagcgtgaatttccattagcaaagacacgtaatattggtattatggcccacatcgatgcgggtaagaccactactactgaacgtatcctttactacactggtaagatccacaaaattggtgaaactcacgaaggtgattcacaaatggactggatggatgaagaaaaggaacgtggtatcactattacttccgcagctactactgcacaatggaaggattacagaattaacattattgataccccaggacacgttgacttcactatcgaagtagaacgttcacttcgtgttcttgatggtgccgtaactgttcttgatgctcaagctggtgttgaaccacaaactgaaaacgtatggcgtcaagctgaaacttacggtgttcctcgtattgtttttgttaacaagatggacaagatcggtgctgactttgacaagtcagttaagtcattacatgaacgtttgaacgctaatgctcaagctgttcaaatgccaattggttcagcagacacttttgaaggtgttattgacttgatcaacatggttgctgatatttatgacgaagacaagcttggttctaagtgggatactgttccagttcctgacgaatacaaagaagaagctgaaaagcgtcgtgctgcattgattgaagctgttgctgatgttgatgacaacattatggaaaagtatcttggcggtgaagaaatttctaatgatgaattgaaggctgctatccgtaaagctactttgaacttggaattcttcccagtatacgcaggttcagcatttaagaacaagggtgttcaaatgatgcttgatggtgttattgattacttgccatcaccacttgatgttaagccttatgttgctcatgatcctaagactggtgacgaagttgaacttatggctgacgataagaagccatttgcagctcttgcatttaagattgctactgacccatttgtaggtcgtttgactttcatccgtgtttacactggttctcttgaatcaggttcatacgtattgaacgcttcaaagaactcacgtgaacgtgtaggtcgtttgcttcaaatgcacgctaactcaagaactgaaatcccagaagtattctcaggtgatattgcaggtgctattggtttgaagaacaccactactggtgactcattaactgatccagatcatccacttattttggaaagtttgcaagttccagatccagttatccaagtatcagttgaacctaaatcaaaggctgaccgtgataagatggacgttgctttacaaaagcttactgaagaagacccaactttccgtgcagaaactaatcctgaaactggtcaaactttgatttcaggtatgggtgaacttcaccttgatatcatggttgaacgtatgagacgtgaatttaacgttgaagctaagattggtgaaccacaagttgcttaccgtgaaacctttactaaggaagctaaagcacaaggtaagttcgttcgtcaatcaggtggtaagggtcaatacggtgatgtatggattgactttactcctaatgaagaaggtaagggctacgaattcgaagacgctatcgttggtggtgttgttcctcgtgaatttatcccttcagttgaccaaggtttacaagaagctatgaagaatggtgttcttgctggttacccattgatcgatgttaaggctaaactttacgatggtagttaccacgaagttgactcatcagaagctgcatttaaggttgctgcttcacttgcattgagaaatgctgcttcaaaggctggcgcagttatcttggaaccaattatgaaggttcaagtaactactccagaagaatacttaggtgatgttatgggttcaatcactgctcgtcgtggtaccatggaaggtatggaagacagagctggtgctaagattattaactcatttgttccactttcagaaatgtttggttacgcaactactttgcgttcatcaactcaaggtcgtggtacatttactatggtatttgatcactactcaccaactcctaagtcaattcaagctgatattattaagaaacgcggcggcgacgctgaa

SEQ ID NO: 96 - protein, 697 aa, Lactobacillus acidophilus
MANKREFPLAKTRNIGIMAHIDAGKTTTTERILYYTGKIHKIGETHEGDSQMDWMDEEKERGITITSAATTAQWKDYRINIIDTPGHVDFTIEVERSLRVLDGAVTVLDAQAGVEPQTENVWRQAETYGVPRIVFVNKMDKIGADFDKSVKSLHERLNANAQAVQMPIGSADTFEGVIDLINMVADIYDEDKLGSKWDTVPVPDEYKEEAEKRRAALIEAVADVDDNIMEKYLGGEEISNDELKAAIRKATLNLEFFPVYAGSAFKNKGVQMMLDGVIDYLPSPLDVKPYVAHDPKTGDEVELMADDKKPFAALAFKIATDPFVGRLTFIRVYTGSLESGSYVLNASKNSRERVGRLLQMHANSRTEIPEVFSGDIAGAIGLKNTTTGDSLTDPDHPLILESLQVPDPVIQVSVEPKSKADRDKMDVALQKLTEEDPTFRAETNPETGQTLISGMGELHLDIMVERMRREFNVEAKIGEPQVAYRETFTKEAKAQGKFVRQSGGKGQYGDVWIDFTPNEEGKGYEFEDAIVGGVVPREFIPSVDQGLQEAMKNGVLAGYPLIDVKAKLYDGSYHEVDSSEAAFKVAASLALRNAASKAGAVILEPIMKVQVTTPEEYLGDVMGSITARRGTMEGMEDRAGAKIINSFVPLSEMFGYATTLRSSTQGRGTFTMVFDHYSPTPKSIQADIIKKRGGDAE

SEQ ID NO: 97 - DNA, 1794 bp, Lactobacillus acidophilus
  CDS (1)..(1794): peptidase, ORF# 1763
atggcaattccaacaagaagtgaagttccagaagaattaaaatgggacttaacccgtgtttttaagacagatgaagactgggaagcagcctttgataatgcaaaagatgaagtagaaaaattaggtgattttaaaaaaatccttactaaatctggcaaagacttatacgaaagtttgacccaaattttagcagttaaacgtcaagtagaaaatatttacgtttatgcaactatgtctagtgatgttgatacttcaaattctcactatttaggttatgtaagccgcgcacaaaatttagttaaccaatttgaggcagtaactagttttatcagcccagaaattctgagtatccctgccgataagtttgaacaattcaaaaaggatgaacctcgtttaaacgattatgctcactatcttgagacaatcactaataagcgtccccacactttacctgctgaagaggaaaaaattatcgcagatgccagtgatgccatgggcgtttcagaaaatacctttaacgttttaactaattcagacatggaatatggctacgttcaagatgacgatggtaatatggaacaattgtctgacggtttgtactcacttttaatccaatcacaaaaccgtgatgtcagaaaaggcgcttttgatacgctttatgcaagctatggtcaattccaaaattcacttgcttctacgctttccggcgttgtaaagaagcacaattataacgctaaagttcacaagtatgattcagctcgtgaagcagctttagctgaaaacaacgtacctaccaaggtttacgacactttgattcgagaagttgactcccatcttgatttacttcaccgttatgtagcacttcggaagaaaattttgggacttaaagatttacaaatgtgggacatgtacgtgccactaactggtaagcctgctctttcatataattttgaagaagcaaaggaagtagctaagaaagctttagctccactgggcgaagattacttaaagcatgttgattatatctttaataatcgcgtaattgatgtagttgaatcaaagaataaagtaactggcgcatattctggcggtgcttatgatacagatccatatgaacttttaaactgggaaaacaacattgactccttatatactctagttcacgaaactggtcactcagttcactcttggtacactcgcaatagccaaccttacgtttatggggattatcctattttcgtagcagaaattgcttcaaccactaacgaaaatattttgactgaatacttcttagatcatattactgattctaagacacgcgcctttattttgaactactatcttgattcatttaaggggacattgttccgtcaaacccaatttgcggtgtttgaacaatttattcatgaagcagatgctaaaggtgaaccacttactgctgatatcttggatgaagtttatggacaacttaaccaacactattacggtgacagcgttgagccaggcggcgatattgcacttgaatggtcacgtatcccgcacttctactacgacttttacgtttaccaatatgcaacaggatttgcggctgcaacagctcttgccaacaaggtggttcatggttctgaagctgatagggatgcatatcttggttttcttaaggctggttcaagtaactatccaaccgaaattatgaagcatgctggcgttgatatgactaagccagactacttggaagatgcatttaagacatttgaaaaacgtttagccgaatttgaaagtttgattgaaaaa

SEQ ID NO: 98 - protein, 598 aa, Lactobacillus acidophilus
MAIPTRSEVPEELKWDLTRVFKTDEDWEAAFDNAKDEVEKLGDFKKILTKSGKDLYESLTQILAVKRQVENIYVYATMSSDVDTSNSHYLGYVSRAQNLVNQFEAVTSFISPEILSIPADKFEQFKKDEPRLNDYAHYLETITNKRPHTLPAEEEKIIADASDAMGVSENTFNVLTNSDMEYGYVQDDDGNMEQLSDGLYSLLIQSQNRDVRKGAFDTLYASYGQFQNSLASTLSGVVKKHNYNAKVHKYDSAREAALAENNVPTKVYDTLIREVDSHLDLLHRYVALRKKILGLKDLQMWDMYVPLTGKPALSYNFEEAKEVAKKALAPLGEDYLKHVDYIFNNRVIDVVESKNKVTGAYSGGAYDTDPYELLNWENNIDSLYTLVHETGHSVHSWYTRNSQPYVYGDYPIFVAEIASTTNENILTEYFLDHITDSKTRAFILNYYLDSFKGTLFRQTQFAVFEQFIHEADAKGEPLTADILDEVYGQLNQHYYGDSVEPGGDIALEWSRIPHFYYDFYVYQYATGFAAATALANKVVHGSEADRDAYLGFLKAGSSNYPTEIMKHAGVDMTKPDYLEDAFKTFEKRLAEFESLIEK

SEQ ID NO: 99 - DNA, 393 bp, Lactobacillus acidophilus
  CDS (1)..(393): ribosomal Protein, ORF# 324
atggcacaacaagctgcatacacaggtactggtcgccgcaaggactcagttgcacgtgttcgtttagtaccaggtaacggtaagattactgttaacggtaaagatattgatcaatacattccattccctaacttagttaaggacttaaagcaacctttaactttaactgaaactgaaggtcaatacgacattcacgttaacgttaacggtggtggtttctcaggtcaagctggagctatccgtcttggtatcgctcgtgctcttcttgaagttgacccagacttccgtggtccacttaagaaggcaggtttcttgactcgtgacccaagaatgaaggaaagaaagaagccaggtttgaagaaagcccgtaaagcttcacaattctcaaagcgt

SEQ ID NO: 100 - protein, 131 aa, Lactobacillus acidophilus
MAQQAAYTGTGRRKDSVARVRLVPGNGKITVNGKDIDQYIPFPNLVKDLKQPLTLTETEGQYDIHVNVNGGGFSGQAGAIRLGIARALLEVDPDFRGPLKKAGFLTRDPRMKERKKPGLKKARKASQFSKR

SEQ ID NO: 101 - DNA, 1014 bp, Lactobacillus acidophilus
  CDS (1)..(1014): glyceraldehyde 3P dehydrogenase, ORF# 698
atgacagttaaaattggtattaacggtttcggccgtattggtcgtttagcattccgtcgtattatggacttgggcgaaaagtcaaaggatatcgaagttgttgcaattaacgacttgactactccagcacttttggcacacttacttaagtatgactcaactcatggtactttcgaccacgaagtttcttcaactgaagattcaatcgtagttgacggtaagaagtaccgtgtttacgctgaaccacaagcacaaaacattccatgggttaaaaacgacggtgttgacttcgttcttgaatgtactggtttctacactagcaaggctaagtcacaagctcaccttgacgcaggtgttaagcgtgtattgatctcagcaccagcaggtaacgacttgaagactatcgtttactcagtaaaccaagatactttgactgctgacgacaagatcgtttcagctggttcatgtactactaactcattggcaccaatggttaacgctttacaaaaggaattcggtattgaagttggtactatgactactatccacgcatacacttcaactcaaatgatcttggatggtcctgtacgtggtggtaacttacgtgctgctcgtgctgctgctatcaacattattcctcactcaactggtgctgctaaggctatcggccttgttattccagaattgaacggtaagttgaacggtcacgcacaacgtgttccagttccagatggttcagtaactgaattagtatcaatcttgggcaagaacgttactgctgatgaagttaacgaagctatgaagaagtacgaaagtccttcatttgaatatgaaccaaacaatgttgtttcaagcgacattttaggcagaactgctggttcaatctttgacccaactcaaactatggtaactactgcaggtgacaagcaattagttaagactgttgcttggtacgacaatgaatactcattcacttgccaaatggttcgtactttgttacactttgctactctt

SEQ ID NO: 102 - protein, 338 aa, Lactobacillus acidophilus
MTVKIGINGFGRIGRLAFRRIMDLGEKSKDIEVVAINDLTTPALLAHLLKYDSTHGTFDHEVSSTEDSIVVDGKKYRVYAEPQAQNIPWVKNDGVDFVLECTGFYTSKAKSQAHLDAGVKRVLISAPAGNDLKTIVYSVNQDTLTADDKIVSAGSCTTNSLAPMVNALQKEFGIEVGTMTTIHAYTSTQMILDGPVRGGNLRAARAAAINIIPHSTGAAKAIGLVIPELNGKLNGHAQRVPVPDGSVTELVSILGKNVTADEVNEAMKKYESPSFEYEPNNVVSSDILGRTAGSIFDPTQTMVTTAGDKQLVKTVAWYDNEYSFTCQMVRTLLHFATL

SEQ ID NO: 103 - DNA, 927 bp, Lactobacillus acidophilus
  CDS (1)..(927): hypothetical protein, ORF# 1511
ttgaatatggctcttaaataccaaattggtgtcgatgcaggtggtactcactcaactgcaatcgcatatgacgaaaatggcaaagaacttggtcgtgccgaaggcggtccaggtcaaattaacgctgactacgaaggcggaattactaacatctctaatacaattaatgaattgttagacaagattgatggcgactgcatgcgcgtacttgttggtattgcaggtctttcagtcgtaggtaacgctccagaagttgcagcaaccatttcatcacgaatcaacaacttgccaactcgtgcaattactgactcacttcttgcactttacgctggtcttgaaggtgacgatggtgccttagttatcgctggtactggttctgtttacaatggtttgcaaaatggtcacttaatcgctgttggtggttacggtaacattttgggcgacgaaggttcaggttacgccatttctcgtgcagctatgcaatctgctcttcttagctgggacaagcgtgaagaaaatggtcttatcgatatgttcaccaacttattcaatgttgaacacatggatgaatgtaatgctaagttctacaagatgtctaacccagaagttgctggtatggctgttcacgttgctaaacttgctgatgctggagataagcacgcagttgcagttatcaaggaacaagctcacttactagctcgtgacattattattggtttgaaccgttacgaagatccaaagccaatgaagattgctttaactggttctgttttagctaacaacgaaatgcttagaggtcttgtagaagacgaagttaaagaagaatatcctgacgttatcttctcaatctcaaacggtgaaaatgcacgtgcagtaatctttgacaagagcaaggattatcgttacttcactaaccatacaaattat

SEQ ID NO: 104 - protein, 309 aa, Lactobacillus acidophilus
MNMALKYQIGVDAGGTHSTAIAYDENGKELGRAEGGPGQINADYEGGITNISNTINELLDKIDGDCMRVLVGIAGLSVVGNAPEVAATISSRINNLPTRAITDSLLALYAGLEGDDGALVIAGTGSVYNGLQNGHLIAVGGYGNILGDEGSGYAISRAAMQSALLSWDKREENGLIDMFTNLFNVEHMDECNAKFYKMSNPEVAGMAVHVAKLADAGDKHAVAVIKEQAHLLARDIIIGLNRYEDPKPMKIALTGSVLANNEMLRGLVEDEVKEEYPDVIFSISNGENARAVIFDKSKDYRYFTNHTNY

SEQ ID NO: 105 - DNA, 1437 bp, Lactobacillus acidophilus
  CDS (1)..(1437): ATP synthase, ORF# 778
ttgagtgaaggtgaaatcgttcaagtaatcggccctgttgtcgatgtaaaattcccaatcgataagaatttacctgatattaacaacgccttacgtgtaatcaagtccgaagatgaaagcatcgttcttgaagttacacttgaactcggtgatggtgttttaagaacaatcgccatggaatctaccgatggtcttcgtcgtggtatgaaagtcgaagatactggcgctccaatttcagttccagttggagaagacactttaggtcgtgtgtttaacgttttaggacagcctattgatggtggtccagcctttccaaaggatcacccacgtgagggtatccacaaggaagcacctaaatatgaagatttaactactagtcgtgaaattcttgaaactggtatcaaggttatcgaccttcttgaaccatatgttcgtggtggtaaagttggtttgtttggtggtgccggtgttggtaaaactactattattcaagaattaattcacaacatcgctcaagaacacggtggtatttccgtatttactggtgttggtgaaagaactcgtgaaggtaatgacctttactttgaaatgaaagcttcaggcgttttaagtaagactgccatggtatttggtcagatgaacgagccgcctggtgccagaatgcgtgttgcattaaccggtttgacacttgctgaatactttagagatgttgaaggtcaagacgtattgctctttattgacaatatctttagatttactcaggctggttcagaggtatctgctttgcttggtcgtatgccaagtgccgtaggttatcagccaactttggcaacagaaatgggtcaattgcaggaaagaattacttctactaagaagggttcaattacttcaattcaagccgtttatgttcctgccgatgactatactgacccagctccatcaaccacattcgcatacttggatgctactactaacttggaacgtagtttagtagaacaaggtatttatccagctgttgatccacttgaatcatcttcaagtgcccttgatcctgaagttgttggtcaggaacactatgaagttgctactcgtgttcaacatgttttgcaacgttaccatgaattacaagatattatttctgttttaggtatggatgaattgtcagatgaagaaaaattgatcgttgctcgtgcacgtaaagttcaattcttcttgtcacaaaacttctttgttgcagaacaatttactggtgtaccaggttcatatgttccaattaaagaaaccattaagggctttaagcttatcttagatggtcaccttgatgatttaccagaagatgccttccgtggtgtcggcccaattgaagatgttttgaagaaagcacaagaaatgggtgtaactccaagtgatccagaagctaaagcattactagaaaag

SEQ ID NO: 106 - protein, 479 aa, Lactobacillus acidophilus
MSEGEIVQVIGPVVDVKFPIDKNLPDINNALRVIKSEDESIVLEVTLELGDGVLRTIAMESTDGLRRGMKVEDTGAPISVPVGEDTLGRVFNVLGQPIDGGPAFPKDHPREGIHKEAPKYEDLTTSREILETGIKVIDLLEPYVRGGKVGLFGGAGVGKTTIIQELIHNIAQEHGGISVFTGVGERTREGNDLYFEMKASGVLSKTAMVFGQMNEPPGARMRVALTGLTLAEYFRDVEGQDVLLFIDNIFRFTQAGSEVSALLGRMPSAVGYQPTLATEMGQLQERITSTKKGSITSIQAVYVPADDYTDPAPSTTFAYLDATTNLERSLVEQGIYPAVDPLESSSSALDPEVVGQEHYEVATRVQHVLQRYHELQDIISVLGMDELSDEEKLIVARARKVQFFLSQNFFVAEQFTGVPGSYVPIKETIKGFKLILDGHLDDLPEDAFRGVGPIEDVLKKAQEMGVTPSDPEAKALLEK

SEQ ID NO: 107 - DNA, 672 bp, Lactobacillus acidophilus
  CDS (1)..(672): 30S protein, ORF# 297
atgggtcaaaagattaacccaaacggttttcgtctcggtgtcatccgtgactgggaatcaaaatggtatgctgacaaaggatacaaggaaactttaaaagaagaccttcaaattagaaaatttatctcagaaaaattgaaggatgcttcagtatctactgttgaaattgaacgtgcagccaacagaattaatatctcaattcatactgctaagccaggtatggtaattggtaaaggtggttctgaagttgaagctttaagaaaacaattaaatgctttaactggtaagcaagttcacattaatattgttgaaattaagaagccagatcttgatgctgaattggtagcagatagtattgctcgtcaacttgaagctcgtattgctttcagacgtgctatgcgtcaagctactcaaagagctatgctcgctggtgccaagggtattaaggttcaaacttcaggtcgtttgaacggtgccgacatggcaagaagagaatggcacactgaaggacgtgttccattacaaactttgagagctgatattgattatgcttgggtaaatgctttcactacttatggtgaaattggtgttcaagtttggatcaaccgtggtgaaatcttacctactcgtaagaacaagccagcttcaaagccagcgaagggaggaaataga

SEQ ID NO: 108 - protein, 224 aa, Lactobacillus acidophilus
MGQKINPNGFRLGVIRDWESKWYADKGYKETLKEDLQIRKFISEKLKDASVSTVEIERAANRINISIHTAKPGMVIGKGGSEVEALRKQLNALTGKQVHINIVEIKKPDLDAELVADSIARQLEARIAFRRAMRQATQRAMLAGAKGIKVQTSGRLNGADMARREWHTEGRVPLQTLRADIDYAWVNAFTTYGEIGVQVWINRGEILPTRKNKPASKPAKGGNR

SEQ ID NO: 109 - DNA, 1290 bp, Lactobacillus acidophilus
  CDS (1)..(1290): hypothetical protein, ORF# 1956
ttgaatgttcactttatacaatttttggaggacaaaatgaacgcaattagcaatttctttcatttaaaggagaacaatacttcctttaagaccgaattattggccggtttgactacttttgtaagtatgtcatacatcctttttgttaatcccaacgttttaggtgcaagtgggatggataaaggtgcgttgtttactgttacagcattatccgcagcctttacctgtattgttatgggactcattgctaactatccaatcgcttcagccccaacattaggtttgaatgcattcttcacttacacagtttgtcttggtatgcacgttaaatggcaaacagccttagccgctgttttagttgcatccatccttttcattttactaactgtttttaaagttcgtgagatgatcatagatgctatccctgccgatattaaatacgcaatttctgctggcattggtttattcatcgctttcatcggacttcaaggtggtaagttaattcaaaatagcgattcaactttagtcactatcggtagtcttaataatcctacagtctggatcactatcttcggtttgatcgttaccatcttcttaatgattgcacgaattcctggtgctatctttatcggtatgatcgtagctgccgtctttggagtagccattggtcaaattccaatgcctaagggtattgtttcttcaattccaagtattgctccaacttttggtcaagcagtttttcatattagtgacatcaacactgttcaaatgtgggttgttgtctttaccttcttattagtaactttctttgatacaactggtactttaattggtttagttcaacaggccggtttaatgaaggacaacaagatgccacgcgccggtgaagctttagctgccgactcatcaggtatgcttgttggttcagtacttggtacctcacctgtcggcgccttcgttgaatcaagttctggtatcgcagttggtggtagaactggtttaaccgcagtttgggttggtattttcttcctaatttctactatcttcagcccaatcttgagcgtctttactactcaagtaactgcacctgccttaatcatcgtcggagttttaatggctgaaaacttggctcacgtacactggactaatctcgaaattgccattccttgtttcctcattgcaatcggaatgcctcttacttactcaatttcagacggtttaggctggggccttatcgtttacccagtttcaatgatcgcagctaagcgttttcaaaggaaatcacaccaa

SEQ ID NO: 110 - protein, 430 aa, Lactobacillus acidophilus
MNVHFIQFLEDKMNAISNFFHLKENNTSFKTELLAGLTTFVSMSYILFVNPNVLGASGMDKGALFTVTALSAAFTCIVMGLIANYPIASAPTLGLNAFFTYTVCLGMHVKWQTALAAVLVASILFILLTVFKVREMIIDAIPADIKYAISAGIGLFIAFIGLQGGKLIQNSDSTLVTIGSLNNPTVWITIFGLIVTIFLMIARIPGAIFIGMIVAAVFGVAIGQIPMPKGIVSSIPSIAPTFGQAVFHISDINTVQMWVVVFTFLLVTFFDTTGTLIGLVQQAGLMKDNKMPRAGEALAADSSGMLVGSVLGTSPVGAFVESSSGIAVGGRTGLTAVWVGIFFLISTIFSPILSVFTTQVTAPALIIVGVLMAENLAHVHWTNLEIAIPCFLIAIGMPLTYSISDGLGWGLIVYPVSMIAAKRFQRKSHQ

SEQ ID NO: 111 - DNA, 1209 bp, Lactobacillus acidophilus
  CDS (1)..(1209): 30S ribosomal protein, ORF# 968
atgtcagaaaacagtaatcaatttttagacgcattaaagcaaatgcaaggagttgaggtcggagatattgtcgatgtcgaagtattagacgttgaagacggccaaatcgatgttggtgttgaaaatgccggtgttgaaggtgttattactcgtcgtgaatacacttcagatcgtaacgcagacttacgtgatttagttaagcctggtgacaagttcaaggccttagtattaagaagagctggtggcgataaggaaaatggtgaattcttcttctcagttacccgcttaaaggaaagagaagctttcgacaagttacaaaaagacttcgaagaaggcaatgctatcgaaggtactgtaacttcatcagttcgtggcggtttgctcgttgatgttggtacacgtggtttcttaccagcttcattaatttctaaccgttacgtttcagatcttaagccatacattggtaagactatgaagcttaagattactgaaatcgatccaaacaagaaccgtttgattctttcacacaaggacttagttgaagaagaacgtgaagaagcatttgataaggttgcatcacaattagttgttggtgacgttgttgaaggtaaagtatcacgtttaactaactttggttcattcatcgatgttggtggtgttgacggtttagttcacatttcagaaatttcttacaagcatgttgacaagccaagtgatgttttgaaggttggtcaggatgtcaaggttaaagtcattggtattgacaatgatagacatcgtatttccctttctattaagcaaactgaaccttctccatttgaacaagctacagctgacttaaacgaaggtgacatttttgaaggtgaagttaagtcattgactaactttggtgcatttgttgaagttgctgatggtatccaaggtttggtacacgtttcagaaatttcaaacaagcatgttgataagccaagtgacgttttgaaggttggtcaaactgttaaagttaaggttttgaatatcgaccctaacgacagaagaatctcactttcaatcaaggctgctgactcaaactcttcttcatcagataaccacaattctcgtccacgtcgttcacgtaacgaaaatacagttaacaagaagtacatgagtgacaacgacaacggctttgctttaggtgacatcattggtgaccaattaaaggaccgtaag

SEQ ID NO: 112 - protein, 403 aa, Lactobacillus acidophilus
MSENSNQFLDALKQMQGVEVGDIVDVEVLDVEDGQIDVGVENAGVEGVITRREYTSDRNADLRDLVKPGDKFKALVLRRAGGDKENGEFFFSVTRLKEREAFDKLQKDFEEGNAIEGTVTSSVRGGLLVDVGTRGFLPASLISNRYVSDLKPYIGKTMKLKITEIDPNKNRLILSHKDLVEEEREEAFDKVASQLVVGDVVEGKVSRLTNFGSFIDVGGVDGLVHISEISYKHVDKPSDVLKVGQDVKVKVIGIDNDRHRISLSIKQTEPSPFEQATADLNEGDIFEGEVKSLTNFGAFVEVADGIQGLVHVSEISNKHVDKPSDVLKVGQTVKVKVLNIDPNDRRISLSIKAADSNSSSSDNHNSRPRRSRNENTVNKKYMSDNDNGFALGDIIGDQLKDRK

SEQ ID NO: 113 - DNA, 1224 bp, Lactobacillus acidophilus
  CDS (1)..(1224): phosphoglycerate kinase, ORF# 699
ttgaggagaatattaatggctaaattaatcatttcagacctcgacgttaaaggtaaaaaagttttagtacgtgtagactttaatgttcctattaaagatggcgttattggtgatgataaccgtatcgttgctgcacttcctactattaagtacattattgaacatggtggtaaggcaattttgcttagccacttaggtcgtgtaaagtcagatgctgataagaaggaattgtcattgaagccagttgctgaacgtttaagcgaacttcttgacaagcctgtaacttttgtaccatcaaacgaaggtaaagaagttgaagaagcaatcgacaacatgaaagacggagatgttgttgttcttgaaaacactagattccaagatatcgacaacgatttcggtaagcgtgaatcaggtaacgatccaaaacttggcgaatactgggcaagtcttggcgatatctttgtaaacgatgctttcggtactgcacacagaagtcacgcttcaaacgttggtattgcaaccgctatgaaggaaaatggtaagcctgctgcagctggttacttacttgaaaaggaaattaagtacttaggtgacgccgttgataatcctgtacacccatttgttactattttgggtggtgctaaggtttcagacaagatcggtgttatcgaaaacttgattcctaagtcagatcacatcttaattggtggtggtatggcttacacattcttagctgctcaaggtcacaagattggtaaatcattatttgaagctgataaggttgatcttgctaaggaattgcttgaaaaggctggcgacaagatcgttcttccagttgacaacgtagctgcaactgaattctcaaacgatgcttcacgtgaagttgttggtgacgacattcctgataatatgatgggtcttgacattggtcctaagactattgctaagtttaaggacatcttaaaggatgctaagactgttgtttggaatggaccaatgggtgctttcgaaatgcctaactttgctgaaggtactttagaagtaggtcgtgctttggcaaaccttactgacgcaactactattatcggtggtggtgactcaactgctgctgctaagcaattgggtatcgcacctaagattagccacatttcaactggtggtggtgcttcacttaactaccttgaaggtaaagtattgccaggtatcgcttgcgtttcagacaag

SEQ ID NO: 114 - protein, 408 aa, Lactobacillus acidophilus
MRRILMAKLIISDLDVKGKKVLVRVDFNVPIKDGVIGDDNRIVAALPTIKYIIEHGGKAILLSHLGRVKSDADKKELSLKPVAERLSELLDKPVTFVPSNEGKEVEEAIDNMKDGDVVVLENTRFQDIDNDFGKRESGNDPKLGEYWASLGDIFVNDAFGTAHRSHASNVGIATAMKENGKPAAAGYLLEKEIKYLGDAVDNPVHPFVTILGGAKVSDKIGVIENLIPKSDHILIGGGMAYTFLAAQGHKIGKSLFEADKVDLAKELLEKAGDKIVLPVDNVAATEFSNDASREVVGDDIPDNMMGLDIGPKTIAKFKDILKDAKTVVWNGPMGAFEMPNFAEGTLEVGRALANLTDATTIIGGGDSTAAAKQLGIAPKISHISTGGGASLNYLEGKVLPGIACVSDK

SEQ ID NO: 115 - DNA, 705 bp, Lactobacillus acidophilus
  CDS (1)..(705): 30 ribosomal protein, ORF# 786
ttgggcgaaaatgtaaatttaagatgcacgaatgttaaacttattcgtaatattttactccagaaattattatttaaattttatggaggatttttcatgtcaagatatacaggtccaagttggaagcgttcaagaagattaggtatctcactttcaggtactggtaaggaacttgcacgtcgtaactacgctccaggtcaacacggtcctaacagccgtggtcgtttgtcagaatatggccaacaattacacgaaaagcaaaagttacgttggatgtacggtttaaacgaacgccaatttagaactttattcattcgcgctggtaagattcgtgaaggtcaacacggtattaacttcatgatcttgcttgaacgccgtttagacagtattgtttaccgtctcggtttagctactactagagaacaagctagacaattagttaaccacggtcacatcactgttgatggcaagcgtgttgacattccttcatacgaagtcagtgttggtcaaactattggcttgaaggataagtcaaagaacttgcaacaaatcagggatgctttggaagcaactactgctcgtccatcatttgtttcatttgatgaaaacaagatggaaggtactcttgtacgtttaccagaacgtgacgaaatggaaccagaaattgacgaatcactcgttgttgaatggtacaacaagttactt

SEQ ID NO: 116 - protein, 235 aa, Lactobacillus acidophilus
MGENVNLRCTNVKLIRNILLQKLLFKFYGGFFMSRYTGPSWKRSRRLGISLSGTGKELARRNYAPGQHGPNSRGRLSEYGQQLHEKQKLRWMYGLNERQFRTLFIRAGKIREGQHGINFMILLERRLDSIVYRLGLATTREQARQLVNHGHITVDGKRVDIPSYEVSVGQTIGLKDKSKNLQQIRDALEATTARPSFVSFDENKMEGTLVRLPERDEMEPEIDESLVVEWYNKLL

SEQ ID NO: 117 - DNA, 243 bp, Lactobacillus acidophilus
  CDS (1)..(243): ribosomal Protein, ORF# 265
atgaaacaaggtattcatccagattttcaaaaggtagttttcatggactcagcaactggtgctaagttcgtagctggttcaactatgaagccagaagaaactatcgaatacgaaggcgaaacttacccattagtacgtgttgaagtttcatcagattcacacccattctacacaggcaagcaaaagtttgctcaagcagatggtcgaatcgaaaagttcaacaagaagtacggcttgaagaag

SEQ ID NO: 118 - protein, 81 aa, Lactobacillus acidophilus
MKQGIHPDFQKVVFMDSATGAKFVAGSTMKPEETIEYEGETYPLVRVEVSSDSHPFYTGKQKFAQADGRIEKFNKKYGLKK

SEQ ID NO: 119 - DNA, 468 bp, Lactobacillus acidophilus
  CDS (1)..(468): ribosomal Protein, ORF# 288
atgcctagaaaaggtcacgtaactaagagagacgttttagcagatccagtttacaactcaaagcttgttactaagttgatcaaccacttaatgatcgatggtaagagagctaaggcatcttcaatcctttacgatgctttcaacattgttcaagacaagactggtaaggaaccacttgatgtatttgaagaagctatgaacaacgttatgccagttttggaagttagagctcgccgtatcggtggttcaaactaccaaatcccagtagaagtacgtcctgaaagaagaactactttaggcttaagatggcttgtttcatacgctcgtttacgtaacgaacatactatggatgaacgtttagctaacgaaatcattgatgcttcaaacaacactggttcagcagttaagaagcgtgaagacgttcaccgtatggctgaagctaaccgtgcatttgcacactaccgcttc

SEQ ID NO: 120 - protein, 156 aa, Lactobacillus acidophilus
MPRKGHVTKRDVLADPVYNSKLVTKLINHLMIDGKRAKASSILYDAFNIVQDKTGKEPLDVFEEAMNNVMPVLEVRARRIGGSNYQIPVEVRPERRTTLGLRWLVSYARLRNEHTMDERLANEIIDASNNTGSAVKKREDVHRMAEANRAFAHYRF

SEQ ID NO: 121 - DNA, 309 bp, Lactobacillus acidophilus
  CDS (1)..(309): 50S Protein, ORF# 1338
atgtacgcaattattaagaccggtggtaagcaatacaaagttgcagaaggcgacagcgtatttgtagaaaagcttgatgctgcagaaggtagcgaagtaacttttgacgaagttatccttgttgctaatggtgacgatgttaaggttggtactccattagtagatggtgctaaggtaactgctaaagttgaaaagcaaggcaaggaaaagaaagttgtaactttcaagtacaagcctaagaagcactcacacagcaagtatggtcaccgtcaaccttatactaaggttacagttgaaaagattgaagct

SEQ ID NO: 122 - protein, 103 aa, Lactobacillus acidophilus
MYAIIKTGGKQYKVAEGDSVFVEKLDAAEGSEVTFDEVILVANGDDVKVGTPLVDGAKVTAKVEKQGKEKKVVTFKYKPKKHSHSKYGHRQPYTKVTVEKIEA

SEQ ID NO: 123 - DNA, 972 bp, Lactobacillus acidophilus
  CDS (1)..(972): ribose P pyrophosphokinase, ORF# 224
atgtcctataaagacgatatgataatttttgccctcaactctaatgtaccgttggcacaaaagattgctgatcgtgtaggtattccactttcaaaatcaagtgttgagcgttttagtgatggcgaaattcaaattaatattgatgaaactgtacgtggtaaagatgtataccttgttcaatcaactagtgatccagttaatgataatttgatggaactcttgatcatgattgatgctgtacgtcgtgctagtgcacgtacaattaatattgtgatcccttactatggttatgcccgtcaagaccgtaagactcgtgctcgtgaaccaattactgctaagcttgttgctgatatgcttcaaactgctggtgcagaccgtattctttcacttgacttgcatgcaccacaaattcaaggtttcttcgatattccagttgataacttaatgggtgcaccactccttgctgattacttcttgcgtaaccacttggaagaagatgcagttgttgtttcacctgatcatggtggtgttactcgtgctagaaaacttgctgaattcttaggttgtcatattgctattgttgataagcgtcgtcctaaggctaacgtcgccgaagttatgaacattattggtgatgttaagggtaagcgtgcaattattatcgacgatatgattgatactgccggtactattactctagctgcacaagcattaattgatgctggtgcaactgaagtttatgcaagtgcaactcatgctgttctttcaggtcctgcaattaagagattgaatgattcaccaattaagaacttggttcttactgattcaattaatcaaccagctgaaaagaagttggataagatgcttttagtatcagttggcccacttatgggtgatgctattaagtgtatccaagaacataaagcacttagtcctttgttcaatactagatacgaagaagacaagcacaag

SEQ ID NO: 124 - protein, 324 aa, Lactobacillus acidophilus
MSYKDDMIIFALNSNVPLAQKIADRVGIPLSKSSVERFSDGEIQINIDETVRGKDVYLVQSTSDPVNDNLMELLIMIDAVRRASARTINIVIPYYGYARQDRKTRAREPITAKLVADMLQTAGADRILSLDLHAPQIQGFFDIPVDNLMGAPLLADYFLRNHLEEDAVVVSPDHGGVTRARKLAEFLGCHIAIVDKRRPKANVAEVMNIIGDVKGKRAIIIDDMIDTAGTITLAAQALIDAGATEVYASATHAVLSGPAIKRLNDSPIKNLVLTDSINQPAEKKLDKMLLVSVGPLMGDAIKCIQEHKALSPLFNTRYEEDKHK

SEQ ID NO: 125 - DNA, 528 bp, Lactobacillus acidophilus
  CDS (1)..(528): single-stranded DNA binding protein, ORF# 8
atggacaaaggtatgattaatagagttgtacttgttggccgattaacacgtgatcctgaattgcgtactactggaagtggaatttcggtagctacgtttactcttgctgttgaccgtcaatttacaaatagtcagggtgagagaggcgcagactttatcagctgtgtaatctggagaaaggctgcggaaaacttctgtaactttacttcaaaaggttcattagttggtattgatggccgtattcaaaccagaagctatgacaataaagatgggcaacgagtatatgtaactgaagttgttgttgataacttctcattacttgaatcacgtaaggatcgtgaagcccgcggtcaaagtggtggatatacaccaaataatggaaatattaacaatcaacctgctaataatttccaaaataatggtggatcacaaaataatccacagattaataacaatcaaagttcttcacaagatccatttgctggatcaggtgatactattgatatttctgatgatgatcttccattc

SEQ ID NO: 126 - protein, 176 aa, Lactobacillus acidophilus
MDKGMINRVVLVGRLTRDPELRTTGSGISVATFTLAVDRQFTNSQGERGADFISCVIWRKAAENFCNFTSKGSLVGIDGRIQTRSYDNKDGQRVYVTEVVVDNFSLLESRKDREARGQSGGYTPNNGNINNQPANNFQNNGGSQNNPQINNNQSSSQDPFAGSGDTIDISDDDLPF

SEQ ID NO: 127 - DNA, 1335 bp, Lactobacillus acidophilus
  CDS (1)..(1335): glucose 6P isomerase, ORF# 752
atgagtttaattaaatttgatagtagtaagttaactccatttattcatgaaaatgaattatctgaaatgcaagcaatggttaatgctgctaatgaagaattacgtgatggtactggtgcaggcagcgatttccgcggttggttaaatttgccagttgattacgacaaagaagaatttgaccgtatcaagaaagcagctaagaagatccaatcagattcagatgttttgatttgtattggtatcggtggttcataccttggtgcacaagctgcaattgaattcttgaatagcaatttctacggcaaggaagacaatggcatgccaactgttgtattctgtggtaactcactctcaggttcatacctctatgaccttattgaatgggtaggtgacaaggactttagtattaacgtaatttctaagtcaggtactactactgaaccatcagtagcattccgtatcttcaaggacaagttaatcaagaaatacggtaaggaagaagctgctaagagaatttacgcaactactgaccgtcaaaagggtgctttgaagactgaagctgatgcagaaggctacgaagaatttgtagttccagatgacattggtggtcgttacagtgttcttactgctgttggtttacttccaattgctgcttcaggtgctgatattgatgaattaatgaagggtgcagcagatgctcgtgctgattacactgatactgatttgtcaaaggctactccataccaatacgcagcaatccgtaacattctttaccgcaagggttacactactgaaattgtagaaaactacgaaccaagtttaagaatgtttggtgaatggtgcaagcaattaatgggtgaatcagaaggtaaggatcaaaagggtatttggccatcaagtgctaactttactactgaccttcactcacttggtcaatacatccaagaaggtttacgtaacttatttgaaactgttattcgtgttgaaaatccacgtcatgatgttaagattccaggcgatgaaaagaacttggatcaacttaacttcttggaaggcaagagcttaaactacgtaaacgatcgtgcttacgaaggtgttgttttggctcacactgatggtggtgttccagttatgactattaatattccagatcaaactgcacatactttaggttatatgatttacttctttgaattagctattgctatttcaggttacttgaatggtattaatccattcaatcaaccaggtgttgaagcatacaagcgtaacatgtttggtcttcttaataagccaggctacgaaaacttacacgacgacttagctaagcgtctt

SEQ ID NO: 128 - protein, 445 aa, Lactobacillus acidophilus
MSLIKFDSSKLTPFIHENELSEMQAMVNAANEELRDGTGAGSDFRGWLNLPVDYDKEEFDRIKKAAKKIQSDSDVLICIGIGGSYLGAQAAIEFLNSNFYGKEDNGMPTVVFCGNSLSGSYLYDLIEWVGDKDFSINVISKSGTTTEPSVAFRIFKDKLIKKYGKEEAAKRIYATTDRQKGALKTEADAEGYEEFVVPDDIGGRYSVLTAVGLLPIAASGADIDELMKGAADARADYTDTDLSKATPYQYAAIRNILYRKGYTTEIVENYEPSLRMFGEWCKQLMGESEGKDQKGIWPSSANFTTDLHSLGQYIQEGLRNLFETVIRVENPRHDVKIPGDEKNLDQLNFLEGKSLNYVNDRAYEGVVLAHTDGGVPVMTINIPDQTAHTLGYMIYFFELAIAISGYLNGINPFNQPGVEAYKRNMFGLLNKPGYENLHDDLAKRL

SEQ ID NO: 129 - DNA, 1803 bp, Lactobacillus acidophilus
  CDS (1)..(1803): pyruvate oxidase, ORF# 1974
atgactaaaattaatggttctgacgcaatgcttaaagttatttacgactggggaatagatcatatttatggttttccaggtggatcttttgattcaagcatgaatgctatttatgactttagagataaaatgaaatttatcgaggtccgccacgaagaagcaggtgcacttgctgcttcttcggaatacaaagtaactggtaaactgggtgtatgtttcggctcagcaggtcctggtgctgctcacttatttaatggcttatatgatgcaaaatatgataaaacaccaatgcttgctatcgttgctaatgtacctactagcaaacaagatattgactttttccaagcatttgacgaagataaatggttcttggatgcaagtgtatggtgtgcttcagcaaagacaccagaacttattcctgtattgactgatgaagctattcgccaagcatatgcaagaaagggtccagcagttttgatcattcctaaggattacggatggcaaaagattgaagataacttccgtgtaagtaagaaggcacaaccaaagcctaactatccagctccaactgaaacttcagtcgaagaggctgtaaagcttttaaaggaagcaaagaatcctactatgtacatcggcgcaggtgctaaagatgctggtgaagaagttaaggaatttgcggaaaaattcaaaactcctattatgtcatcatacctaggtaaaggcgtggttgaagataagttcccagcttacattggtactattggtcgtattggccctaaggcagcacaagaagttcaaacagcaactgacctggttgtttgggtaggtaataactcaccattttcaggcttgtggttccctaaggatgctaaggttatccaaatcgatgttgacccaggtaaatttggtaagcgtcattcaactgatgtttcaatgcttgcggattctaagaaagctcttcgtgctcttattgaagaaggggaagaaagaagcgaatcaccactttataaagcagctattgcagaccgcgagaactgggatgcatgggaagatagctttaagaattctgatgaaatgccagttcgtccagaacctatatgggatgttatcaacaagaaagctgatgacaatgcgatttttgcaattgatgtaggtaatgtaaatgttgattcatgtcgtcttttgaatttacatgatgatcaaaagtggactacttctggtcttcacgcaactatgggttatggtgccccagctgctcttatggctgctacagtatatccagaccgtgaagtttggaacttagccggtgatggcggctttgccatgatgaatcaagagcttttgactatgtcacgttacaatatgcatgttttaaatgtggtatttactaacgaaactttaggttatatcgaggctgagcaagttgatgaatctcaccagcctttgtcaggcgttattattcctgataataattgggcaaaagtggcagaaggtatgaacgttaagggcgttgttgtacgtactaaagaagaatttgaaaaagcagtagatgaattcaagcaaatggatggtccaatgcttatcgatattaagtacactcacaagatgccatattcaactgaattgaattcacttgatgatccagcatttgttaagaaatatgaagctgaagatttgaagccgtttagttactttgcagaaaagtatggcttggaagctgatgccgcaacgggtgcatctcaacatgaaggagaaccagtagaagatacaactcctgatacagtttcaggtgcatctcaacac

SEQ ID NO: 130 - protein, 601 aa, Lactobacillus acidophilus
MTKINGSDAMLKVIYDWGIDHIYGFPGGSFDSSMNAIYDFRDKMKFIEVRHEEAGALAASSEYKVTGKLGVCFGSAGPGAAHLFNGLYDAKYDKTPMLAIVANVPTSKQDIDFFQAFDEDKWFLDASVWCASAKTPELIPVLTDEAIRQAYARKGPAVLIIPKDYGWQKIEDNFRVSKKAQPKPNYPAPTETSVEEAVKLLKEAKNPTMYIGAGAKDAGEEVKEFAEKFKTPIMSSYLGKGVVEDKFPAYIGTIGRIGPKAAQEVQTATDLVVWVGNNSPFSGLWFPKDAKVIQIDVDPGKFGKRHSTDVSMLADSKKALRALIEEGEERSESPLYKAAIADRENWDAWEDSFKNSDEMPVRPEPIWDVINKKADDNAIFAIDVGNVNVDSCRLLNLHDDQKWTTSGLHATMGYGAPAALMAATVYPDREVWNLAGDGGFAMMNQELLTMSRYNMHVLNVVFTNETLGYIEAEQVDESHQPLSGVIIPDNNWAKVAEGMNVKGVVVRTKEEFEKAVDEFKQMDGPMLIDIKYTHKMPYSTELNSLDDPAFVKKYEAEDLKPFSYFAEKYGLEADAATGASQHEGEPVEDTTPDTVSGASQH

SEQ ID NO: 131 - DNA, 1755 bp, Lactobacillus acidophilus
  CDS (1)..(1755): oligopeptide ABC transporter, ORF# 1300
atgaaaaaggcaaaaatttttgctggtattacactattatcaggtgtagctcttactttagctgcttgtggtaattcagaatctaattctaatgaatcttctactgcagctaagtttagttcagcagtaccaaagaaggctactaaaaatggtggtactgtaaaggtagctgttgaaactgataccccatttactggtatctttaatgatgaactttcaacttcagcaactgatactggagttatgcaatatggtgctgaatcactttttgctacagatgatcaatatgtctttactgataaaggtgcagctactattaagattaaccaaaaggctaagactgcaactattaatattaagaaaaatgttaagtggtcagatggtaagcctgtaactgctaaagactatgaatatgcttacgaaattattgctaacaaggcaactaagtcacaacgttatacttcaagtttagctgacttagtaggtcttgaagaatatcatgaaggtaagtcaaatactatttcaggtattgaaatgccagatggtgacaatggtcgtaaagttattcttcactttaagactatgaaacctggtatgaatactagtggtaatggttatatctggggaacagcagctccatatcactacttaaaggatgttaaatttaaagatttaatgtcaagtgacaagattcgtaagaaacctttattctttggcgcatacaagcttcaaaaagttgttcgtggtcaatcagtaacctgggttcctaacgaatactactacaagggtaaaccaaagcttagcaagattactgctagtgtaattaaccctaattcagttgctcaaagtattaagtcaaataagtttgatgtaatctcagttattaactcacaatggcaaaatgtaaagggaactaagggcgtaaactttattgctcaagttccactctcatactcataccttggctttaaggttggtaaatgggatgctcaaaggggcgaaaatgttatgaatcctaagtcaaagatgaataacaaggctcttcgtcaagctattgcatatggtatgaatgttgatcaagtttacaagcgttacacatatggcttaagctttagagtccctactttaattcctaagcaatttggtgactacttcgataagaatgtaaagggctatagctacaacattaaaaagggtaacgaaatcttagacaaggctggatttaagaagaaaggaacttaccgtgtacaaccaaatggtaaacctttaactatccgtcttgctgctatgactggtaactcaactcaagaaccaatcgttcaaaactacatccaacaatggaagaaggaaggtttgaacgttaaattaactggcggtcgtttaattgaatttaattcattctatgacaagattcaaaatgatgatccatcagttgatatgttcttaggtgcatggtcactttcaagtgaaccatcaccaaacgacctgtatggtgaaaaagcaccaatgaactactcaagatttgtaactaagaagaacaaccaacttcttgaggaaatggattcacaaaaagcatttaaccatacatacagagtagataaattccacgaatggcaaaagtatatggatgatcaggcatacgtagttcctgtagctaacagctattcaattagtgctgtcaacaagaagcttactggttactcacttaagccatcagatggttgccctaactggtacaatgttgcttacgctaag

SEQ ID NO: 132 - protein, 585 aa, Lactobacillus acidophilus
MKKAKIFAGITLLSGVALTLAACGNSESNSNESSTAAKFSSAVPKKATKNGGTVKVAVETDTPFTGIFNDELSTSATDTGVMQYGAESLFATDDQYVFTDKGAATIKINQKAKTATINIKKNVKWSDGKPVTAKDYEYAYEIIANKATKSQRYTSSLADLVGLEEYHEGKSNTISGIEMPDGDNGRKVILHFKTMKPGMNTSGNGYIWGTAAPYHYLKDVKFKDLMSSDKIRKKPLFFGAYKLQKVVRGQSVTWVPNEYYYKGKPKLSKITASVINPNSVAQSIKSNKFDVISVINSQWQNVKGTKGVNFIAQVPLSYSYLGFKVGKWDAQRGENVMNPKSKMNNKALRQAIAYGMNVDQVYKRYTYGLSFRVPTLIPKQFGDYFDKNVKGYSYNIKKGNEILDKAGFKKKGTYRVQPNGKPLTIRLAAMTGNSTQEPIVQNYIQQWKKEGLNVKLTGGRLIEFNSFYDKIQNDDPSVDMFLGAWSLSSEPSPNDLYGEKAPMNYSRFVTKKNNQLLEEMDSQKAFNHTYRVDKFHEWQKYMDDQAYVVPVANSYSISAVNKKLTGYSLKPSDGCPNWYNVAYAK

SEQ ID NO: 133 - DNA, 270 bp, Lactobacillus acidophilus
  CDS (1)..(270): 30S ribosomal protein, ORF# 841
ttggaggtgaatttcatgccacaaattaaatcagctatcaaacgtgttaagacgcaaaatgctactaacaaacgcaacgcttctgaattaagcaagttaagaactgctattaagaaatttaagaacgctgttgaaactgatagtaaagaagacgtctccaagttgcatttagaagctgttcgcgctttggacaaggctgcttcaaagggcttaatccacaagaacaaagctgctcgtgataagagtcgtttaactaagttagcaaacaag

SEQ ID NO: 134 - protein, 90 aa, Lactobacillus acidophilus
MEVNFMPQIKSAIKRVKTQNATNKRNASELSKLRTAIKKFKNAVETDSKEDVSKLHLEAVRALDKAASKGLIHKNKAARDKSRLTKLANK

SEQ ID NO: 135 - DNA, 1029 bp, Lactobacillus acidophilus
  CDS (1)..(1029): transcriptional regulator, ORF# 697
atggattcggacttttctttgctcgaagcgctcgttcccgacgtcttaaagatccttcgacaaaggtatcttgtccttgagcaaattgctttgcatgctccgataggtcgtcgaagtgttgctcagcatttaggactttcagaaagaaacattagaactgaaactgaatatttaagtcaattaggattaattgaaattaaaagttttggcatgtttttaactgaaaagggcgagaagacattaaaagatgcaggtctgttgattgatcgtctctttaatgctcgtgaaactgaagtagagttagctaaaaaacttggaattgaaagaacattaatagttccaggaaatgctgatttgcaggaccgagtttatgaggaaatgggagagaaattaagttcagctttgaatttactcttgccattaggtcattcaatagttacaattctaggtggagcttctttagcaaaatctgctaaatatttatctccagatcttggcaataatcgccaattagaatttgttcctggtcgaggagctctgggcgaaaatgtagagacgcaaagtaatacaatcgttcaagagatggcggctaaaacttcaggtacttataaaactttgtatttacctgaacaagtttcagctgatgcgtataagtcacttatacgggaaccttcgattgtggacgttctgcaagatatttcacaaagcgatgctgtaattcatggaattgggttagctcaagaaatggcacagcgtagaggttatgattcaattaaactttcagagcttcgtgaaaagaaagccgtcaccgaatgttttgggtgtttcttcgatgaaaatggtaaggttgttgaccgtatcacccaggttggattacagtttgacaatctatataaaataccccacatatttgcctttgcttgcggtgctaaaaaagctaaagcaattaaagcatatatgcccaatgcacctcatcaaacctggttaattactgatgaaggggcctcaaatatgattttaaaggggaaa

SEQ ID NO: 136 - protein, 343 aa, Lactobacillus acidophilus
MDSDFSLLEALVPDVLKILRQRYLVLEQIALHAPIGRRSVAQHLGLSERNIRTETEYLSQLGLIEIKSFGMFLTEKGEKTLKDAGLLIDRLFNARETEVELAKKLGIERTLIVPGNADLQDRVYEEMGEKLSSALNLLLPLGHSIVTILGGASLAKSAKYLSPDLGNNRQLEFVPGRGALGENVETQSNTIVQEMAAKTSGTYKTLYLPEQVSADAYKSLIREPSIVDVLQDISQSDAVIHGIGLAQEMAQRRGYDSIKLSELREKKAVTECFGCFFDENGKVVDRITQVGLQFDNLYKIPHIFAFACGAKKAKAIKAYMPNAPHQTWLITDEGASNMILKGK

SEQ ID NO: 137 - DNA, 3639 bp, Lactobacillus acidophilus
  CDS (1)..(3639): RNA polymerase, ORF# 284
ttgttaaatggacacgtagtgaactacggtaaacatcgaactagacgtagcttctcccgaattaaggaagtattgaagttacctaacttaactgatgttcaaaccgaatcatataagtggtttcttgataaaggcattaaagaagtctttgatgacattatgcctattagtgacttctcaggtaagctttcattagagtatgtaggctacaaacttcaaaagcctaagtatacagttgatgaagctcgtgatcatgatgcaacttatgctgcaccaatgcatgtaactttgaagcttactaaccaagaaactggtgaaattaagactcaagatgtattctttggcgatttaccattaatgactgaatcaggttcattcatagttaatggtgctgaaagagttattgtttctcaattagttagatctccaggtgtttactacactggtgattatgataagaatggtcgtcaaatttttggtactactgttattcctaaccgtggtgcttggcttgaatatgaaactgatgctaaaaatgtttcttatgttcgagtagaccgtactcgtaagttgcctcttactgtattgattagagcaatgggtattggctcagacagtgaaattattgaaatgtttggtcaaagtgatactttgcaatttactttggacaaggatgttcataaaaatccagctgactcacgcgtagctgaagctttgaaggatatttacgaaagacttcgtccaggtgaaccaaagactactgattcatcacgttcacttttgtatgctcgtttctttgacccacgtcgttatgacttggcaccagttggacgttacaagattaacaagaagctttctcttaagaatcgtttgtatggtcaaactttagctgaaactttagctgatcctgatactggtgaaattattgttaagaaggatactgtagttactcacgaaattatggacaagttagctccataccttgatcgcgatgacttcaagatggtcacttaccaaccttcaaaagaaggtgtattaccagatcctattacagttcaagaaattaaggtttactcaaaggtagatcctgaacgtgaagttaaattaatgtcaaatggtcacattgatgcagatgttaagcatttgactccagctgatgttttagcttcaattaattacttctttgctttacaagataagatcggtactactgatgatatcgaccacttgggtaaccgtcgtattcgtcgtgttggtgaacttcttcaaaatcaatttagaattggtttggcaagaatggaacgtgttgttcgcgaaagaatgtcaatccaagacccatcaactgttaccccacaacaattgattaacattcgtccaattgttgcaagtatcaaggaattcttcggttcatcacagctttcacagtttatggaccaacacaacccattgggtgaattgacacataaacgtcgtatgtcagccttagggcctggtggtttaactcgtgaccgtgccggatatgaagttcgtgacgttcactatactcactatggtcgtttgtgtcctattgaaactccagaaggacctaacattggtttgattaactcacttgcttcatacgcaatcattaataagtatggtttcattgaaacaccatatcgtcgtgtttcttgggatacccacaaggtaaccgataaaatcgattatttgactgctgatgaagaagataactacattattgccggtgctaacactcctttgaatgatgatggttcatttaaagaagacataattttggctcgtcaaaaggaagataacgtcgaagttactccagataagattgactacatggacgttatccctaagcaagttgtttcagtagcttcagcatgtatcccattcctagaaaacgatgactctaaccgtgctttgatgggtgccaaccagcaacgtcaggctgctcctttgattaacccacacagttcccttgttggtactggtatggaatatcgtgcagctcacgactcaggtgctgcattaattgctaaggcagctggtactgttgaatacgttgatgctgatgaaattcgtattagacgtgaagatggtactttagacaagtacactcttgaaaaataccgtcgttcaaacaactctaagtcatacaaccaaactcctaatgttaaattgggtgatcacgttgatgaaagtgatgtaattgctaatggtccaactatggatcatggtgaacttgcattaggtcaaaacccactcattgctttcatgacttggaacatgtacaactatgaagatgccatcatgctttcagaacgtttggttaaggatgatgtatatacttcaattagtatcgaagattatgaatcagaagctcgcgatactaagcttggaccagaagaaattacaagagaacttcctaacatcggtgaagatgctttgaaggatcttgatgctgatggtatcgttcgtgtcggtgctgaagttcatgatggtgatattttggtgggtaaggtaactcctaagggtgtaactgaattatctgctgaagaaagattacttcacgctatctttggtgaaaaggctcgtgaagttcgtgatacttcacttcgtgtaccacatggtggtggcggtatcgttcaagacgttaaggtttatactcgcgaagccggcgatgaactttcaccaggtgtaaatactatggttcgtgtttacattgcacaaaagagaaagattcaagttggggacaagatgtctggtcgtcacggtaacaagggtactgttgctgcagttatgccagaagaagatatgccataccttccagatggtactccagtagatatttgtttgaacccaatgggtgttccatcacgtatgaacattggacagcttcttgaattgcacttgggtgctgctgctcgtcaattaggtattcacgtagcaactccagtatttgatggtgctaatgaaaatgatgtttgggatactgtacgtcaagcgggtatggataaagatggtaagacagttatttatgatggtcgtaccggtgaaccattccacaaccgtgtgtcagtaggtgtcatgcactacttgaaacttactcacatggttgacgacaagatccacgctcgttcaattgggccatactcattggttactcaacaacctttgggtggtaaagctcaattcggtggacagcgttttggtgaaatggaagtttgggctcttgaagcttatggtgcagcttacacattacaagaaattttgacttataagtcagatgatgttgttggtcgtgtaaaggcatatgaagctattgttaagggcgaaagaattcctaagccaggtgtaccagaatcattccgtgttcttgttaaggaactccaatcattaggtttggatattcgtgtccttgatatggatcataatgaaattgaacttcgtgatatggatgaggattcaagtgaacacttgaatatcgatactttgtcacgtatggcagaagaacaagaaaagaagaagttagccgaagaaactggaaaatcagagaataaagaagatagtaatgaaactgcagataagccagtagctcctgcagatgaatctgacggtaaagtttctaaa

SEQ ID NO: 138 - protein, 1213 aa, Lactobacillus acidophilus
MLNGHVVNYGKHRTRRSFSRIKEVLKLPNLTDVQTESYKWFLDKGIKEVFDDIMPISDFSGKLSLEYVGYKLQKPKYTVDEARDHDATYAAPMHVTLKLTNQETGEIKTQDVFFGDLPLMTESGSFIVNGAERVIVSQLVRSPGVYYTGDYDKNGRQIFGTTVIPNRGAWLEYETDAKNVSYVRVDRTRKLPLTVLIRAMGIGSDSEIIEMFGQSDTLQFTLDKDVHKNPADSRVAEALKDIYERLRPGEPKTTDSSRSLLYARFFDPRRYDLAPVGRYKINKKLSLKNRLYGQTLAETLADPDTGEIIVKKDTVVTHEIMDKLAPYLDRDDFKMVTYQPSKEGVLPDPITVQEIKVYSKVDPEREVKLMSNGHIDADVKHLTPADVLASINYFFALQDKIGTTDDIDHLGNRRIRRVGELLQNQFRIGLARMERVVRERMSIQDPSTVTPQQLINIRPIVASIKEFFGSSQLSQFMDQHNPLGELTHKRRMSALGPGGLTRDRAGYEVRDVHYTHYGRLCPIETPEGPNIGLINSLASYAIINKYGFIETPYRRVSWDTHKVTDKIDYLTADEEDNYIIAGANTPLNDDGSFKEDIILARQKEDNVEVTPDKIDYMDVIPKQVVSVASACIPFLENDDSNRALMGANQQRQAAPLINPHSSLVGTGMEYRAAHDSGAALIAKAAGTVEYVDADEIRIRREDGTLDKYTLEKYRRSNNSKSYNQTPNVKLGDHVDESDVIANGPTMDHGELALGQNPLIAFMTWNMYNYEDAIMLSERLVKDDVYTSISIEDYESEARDTKLGPEEITRELPNIGEDALKDLDADGIVRVGAEVHDGDILVGKVTPKGVTELSAEERLLHAIFGEKAREVRDTSLRVPHGGGGIVQDVKVYTREAGDELSPGVNTMVRVYIAQKRKIQVGDKMSGRHGNKGTVAAVMPEEDMPYLPDGTPVDICLNPMGVPSRMNIGQLLELHLGAAARQLGIHVATPVFDGANENDVWDTVRQAGMDKDGKTVIYDGRTGEPFHNRVSVGVMHYLKLTHMVDDKIHARSIGPYSLVTQQPLGGKAQFGGQRFGEMEVWALEAYGAAYTLQEILTYKSDDVVGRVKAYEAIVKGERIPKPGVPESFRVLVKELQSLGLDIRVLDMDHNEIELRDMDEDSSEHLNIDTLSRMAEEQEKKKLAEETGKSENKEDSNETADKPVAPADESDGKVSK

SEQ ID NO: 139 - DNA, 705 bp, Lactobacillus acidophilus
  CDS (1)..(705): glycerol uptake facilitator, ORF# 1436
atgtcaggtttcattggtgagttcctaggaactatggtattaatcgttttaggaaccggatgtggcgcagcgattaacttgaataaatcctacgccaaaggttcccactggctatacgtaaccattgcttggggtatggccgttacatttggtgtttatgttgctgcaaactttggctcacaaggtcacttaaatccagctgtcacaattgggtttgcggctttcggatttttcccttggagcggagtcttaccttatttattaggtcagtttttaggtgcttttgtcggtgcagtacttgtaattattcaatactaccctcactttaaagcaaccaaaactaccgaagaaggtaatcaagtaggtattttcgctacagcaccggctattaagaataatttattcaacttcctaagtgaaacaatcgcaacatttatttttatctttgctttacttaacttaggtgattttgataaaggtcttaagccattaattgttggtttattgattatggtagttggacaaggtctaggtgctactactggatttgctttaaaccccgctcgtgattggtcaccaagacttgcttatacaatcttgcctgtaccgaataaatcaagtgctaattggcaatacgcatgggtaccaatgtgtggtcctatcgttggtggtcttttagcttcagcattacaatacttcttaaaa

SEQ ID NO: 140 - protein, 235 aa, Lactobacillus acidophilus
MSGFIGEFLGTMVLIVLGTGCGAAINLNKSYAKGSHWLYVTIAWGMAVTFGVYVAANFGSQGHLNPAVTIGFAAFGFFPWSGVLPYLLGQFLGAFVGAVLVIIQYYPHFKATKTTEEGNQVGIFATAPAIKNNLFNFLSETIATFIFIFALLNLGDFDKGLKPLIVGLLIMVVGQGLGATTGFALNPARDWSPRLAYTILPVPNKSSANWQYAWVPMCGPIVGGLLASALQYFLK

SEQ ID NO: 141 - DNA, 1518 bp, Lactobacillus acidophilus
  CDS (1)..(1518): ATP synthase alpha subunit, ORF# 776
gtgaaaccattgagcattaaagcggaagaaattagctccttgatcaagcaacaacttgaacattacgatgataagctcgatatcaacgaagttggtgttgtaacttatgttggtgatggtatcgcccgagctcacggactagatgatgtattgtctggtgagttattaaaatttgataacggttcatttggtattgctcaaaaccttgaatcaaatgatgttggtatcattattttaggtcaatttgacaatattcgtgaaggtgaccgtgttcaaagaactggtcgaatcatggaagttcctgttggtgacgccttaatcggtagagtagttaacccattgggtcaaccagtggacggtttaggtgaaattaagtctgacaagactcgtcctattgaagctaaagctccaggtgttatggaccgtcaatcagttaatcaaccacttcaaactggtattaaggctattgatgccttagttcctattggtcgtggtcagcgtgaattgattattggtgaccgtaagactggtaagactagtttggctattgatactatccttaatcaaaaaggacaagacgtaatttgtatttacgttgctattggtcaaaaggaatcaaccgttagaactcaagtagaaactttaaagcgttttggcgcaatggattacactattgttgttgaagcgggcccaagcgaaccagctcctatgctttatattgcaccatatgctggtaccgcaatgggtgaagaatttatgtacaatggcaaggatgtattgatcgtatttgacgacctatccaagcaagctgttgcttaccgtgaactttccttgcttctccgtcgtccgcctggtcgtgaagcttatccaggtgacgtcttctacttgcactcacgtttacttgaacgtagtgctaagttaagtgacaaacttggtggtggatcattgacagctttgccaattattcaaactgaagccggagatatttctgcatatattccaaccaacgtaatttcaattactgacgggcagattttcttgcaaagtgatttattctttgctggtactcgtccagctattgacgctggtaactcagtttctcgtgttggtggtaatgctcagatcaaggcaatgaagaaggttgctggtactttacgtactgaccttactgcttatcgcgaacttgaaagtttcgcccaatttggtagtgatcttgatcaagcaactcaagctaagcttaatagaggtcaaagaactgttgaagttttgaagcaaccacttcatgatccaattcctgtagaaaagcaagttttaattctttatgctttgactcatggctatcttgatgctattccagtcgaagacattagtcgtttccaaaatgaattgtttgataattttgatagcagtcatgctgatttgcttaagacaattcgtgaaaccggtaaattaccagatgacaaggaattatcagcagctattgaggaattcagtgaaagctttacaccaagtgaaaaa

SEQ ID NO: 142 - protein, 506 aa, Lactobacillus acidophilus
MKPLSIKAEEISSLIKQQLEHYDDKLDINEVGVVTYVGDGIARAHGLDDVLSGELLKFDNGSFGIAQNLESNDVGIIILGQFDNIREGDRVQRTGRIMEVPVGDALIGRVVNPLGQPVDGLGEIKSDKTRPIEAKAPGVMDRQSVNQPLQTGIKAIDALVPIGRGQRELIIGDRKTGKTSLAIDTILNQKGQDVICIYVAIGQKESTVRTQVETLKRFGAMDYTIVVEAGPSEPAPMLYIAPYAGTAMGEEFMYNGKDVLIVFDDLSKQAVAYRELSLLLRRPPGREAYPGDVFYLHSRLLERSAKLSDKLGGGSLTALPIIQTEAGDISAYIPTNVISITDGQIFLQSDLFFAGTRPAIDAGNSVSRVGGNAQIKAMKKVAGTLRTDLTAYRELESFAQFGSDLDQATQAKLNRGQRTVEVLKQPLHDPIPVEKQVLILYALTHGYLDAIPVEDISRFQNELFDNFDSSHADLLKTIRETGKLPDDKELSAAIEEFSESFTPSEK

SEQ ID NO: 143 - DNA, 864 bp, Lactobacillus acidophilus
  CDS (1)..(864): membrane protein, ORF# 1376
ttgatgagttatttatttctatttattcccgcaatcggatggggacttatgccactattcgttgcaggggtcaagaagagtaatatttaccaccaaatcgtagggtcagtattaggcgcatttttatttggtatcgtagtattcttgattaagcgtccggaatttaacgctacatcattcttacttgcaatggtggccggtgcttcatgggtagttggtcagtgtggtcagtattacagttacgcaaaggttggggtttcagaaaccatgccgatctcaactggtttacaactgatcggtgtaccacttgttggggtcttaatttttggcgaatgggcaagtacacaagctaaattgtttggcttccttggtattctggcattaattatcggtgtagcatttacttctttaaccgataagggtaccgcagaaggtggtaagaagaatcagactactactatgattgttttatttttgaccaccttaggttacattgcttcaagttctattccaaaggctttaaaaggcgatggagtaatgattttcctaggtcaaacaatcggtatgttgatcgcaactctcgtttacatcgttgcttctaagcaacttaaagtctttaaggaaaaagaaagttatcaagttattccagccggtgtaatctttgcgattgctgcactttcatacatcatttctgtacaaatgaatggtgttaacttggcattcgttatgtcacaactttgtgtagttatttcaactcttggtggtattattttcttacatgaaaagaagactaagaagggctacatttatacagtgatcggtttagtactgatcgttgctggtgcaattttaacttcagtattt

SEQ ID NO: 144 - protein, 288 aa, Lactobacillus acidophilus
MMSYLFLFIPAIGWGLMPLFVAGVKKSNIYHQIVGSVLGAFLFGIVVFLIKRPEFNATSFLLAMVAGASWVVGQCGQYYSYAKVGVSETMPISTGLQLIGVPLVGVLIFGEWASTQAKLFGFLGILALIIGVAFTSLTDKGTAEGGKKNQTTTMIVLFLTTLGYIASSSIPKALKGDGVMIFLGQTIGMLIATLVYIVASKQLKVFKEKESYQVIPAGVIFAIAALSYIISVQMNGVNLAFVMSQLCVVISTLGGIIFLHEKKTKKGYIYTVIGLVLIVAGAILTSVF

SEQ ID NO: 145 - DNA, 960 bp, Lactobacillus acidophilus
  CDS (1)..(960): ATP synthase gamma subunit, ORF# 777
atgcctgcatctttacttgagttaaagagaaaaattgcttcagttaaacaaactggtaaaattacagaagctatgagaatggtttctgcatcaaagttgaatcaaacagaaaatcgtgataaggattatacagtttataacgatcatgttcgtaaaactatttctcacttaattagttcacaagtggttgatagtttacgtgaaagagatatttcaattgataaaaataatatctctaagatcgattatactgatgtctttggtctaggtattactgctgatatgattcaaccacgtaagaatatcaagacaaccggattcttagttgttactggtgatcgtggattggtaggttcttacaatagttcagttattaagaatatgatgagtatttttgatgacgaacgtgcacaaggacgtgaagtgaaagttcttgctgttggatctgttggagcacaattctttaagaaaaataacgttaatgttgtttatgaaaaagatggtgtttctgatgtgcctacttttgatgaagttttaccaattgtttcaaccgctattaagatgttcttgaatggcgtatatgatcagctttatgtatgttatacgcaccatgtaaattcattgtcatctgctttccgtgttgaaaaaatgttaccaattgtcgatttagatattggtgttaaagaagctgaagcacataaagaattagaatatgatattgaaccagatgttaacagcgtattaatgaagttacttcctcaatatgctcgttcaactatctatggtgctatcttagatgcaaaaactgctgaacatgctagttcaatgacagcaatgcagagtgcaactgataacgctaatgatttagtatcaaatttaactacaaaattaaatcgtgctagacaggcacagattaccactgaaattactgaaattatcagtggtgcaaatgccttagag

SEQ ID NO: 146 - protein, 320 aa, Lactobacillus acidophilus
MPASLLELKRKIASVKQTGKITEAMRMVSASKLNQTENRDKDYTVYNDHVRKTISHLISSQVVDSLRERDISIDKNNISKIDYTDVFGLGITADMIQPRKNIKTTGFLVVTGDRGLVGSYNSSVIKNMMSIFDDERAQGREVKVLAVGSVGAQFFKKNNVNVVYEKDGVSDVPTFDEVLPIVSTAIKMFLNGVYDQLYVCYTHHVNSLSSAFRVEKMLPIVDLDIGVKEAEAHKELEYDIEPDVNSVLMKLLPQYARSTIYGAILDAKTAEHASSMTAMQSATDNANDLVSNLTTKLNRARQAQITTEITEIISGANALE

SEQ ID NO: 147 - DNA, 711 bp, Lactobacillus acidophilus
  CDS (1)..(711): ATP synthase subunit a, ORF# 772
atggagaaatcatttgtttttaaattcatgggcttgaattttgatcttactgggatcattggttcaacgctaatggctttggcagtttttcttatctgcgtttggcttgcacgaaaagtagaaatgaaaccaaataaaagacaaaatgtatttgaatatctattagattttactgacggtattgtaaaagataacgttagcgatgtagatgctcagaagcacttgtcattatatgctttcgttttattccttttcatttggtttatgaaccaattgggaatgttcctagaagtcaaagttgatgattgggtgtttattaaatcaccaactgccgatccagtagcgacaatgtcgtttgcaatgatgaccttgcttctatcgttcacattcggcgtacaaagatttggtgtaggcggatatttaaagaattatgcgcaaccagttggttttttacttccagttaatgtaattgaagaatttaccaacttcttaaccttatcattacgtctttatgggaatatatatgctggtgaagttttgctaacattaattggtaatgatctagcacatgctggtggaccatttacattgattctagcagctccattagccatggtttggcaaggtttctctgtcttcattggctctatccaggcatatgttttcgtaactttgtcaatggtttacattggtaagaaagttactacagaa

SEQ ID NO: 148 - protein, 237 aa, Lactobacillus acidophilus
MEKSFVFKFMGLNFDLTGIIGSTLMALAVFLICVWLARKVEMKPNKRQNVFEYLLDFTDGIVKDNVSDVDAQKHLSLYAFVLFLFIWFMNQLGMFLEVKVDDWVFIKSPTADPVATMSFAMMTLLLSFTFGVQRFGVGGYLKNYAQPVGFLLPVNVIEEFTNFLTLSLRLYGNIYAGEVLLTLIGNDLAHAGGPFTLILAAPLAMVWQGFSVFIGSIQAYVFVTLSMVYIGKKVTTE

SEQ ID NO: 149 - DNA, 3651 bp, Lactobacillus acidophilus
  CDS (1)..(3651): DNA directed RNA polymerase beta subunit, ORF# 285
ttgatcgacgtaaataagtttgaaagtatgcaaattggtcttgcatcacctaacaagatcagaagctggtcgtatggtgaagttaagaagccagaaaccatcaactaccgtactttaaagccagaaaaagatggcttgtttgatgaaagaatttttggaccaactaaagattggtcatgtgcttgtggtaagtacaagggtgttagataccgtggtatcgtttgtgaccgttgtggtgtagaagttacttcttcaaaggtaagaagagaacgtatgggtcacattgaattagctgctcctgtaactcacatttggtacttcaaaggtatcccatcaagaatgggattggtattggatatttctccaagattgcttgaagaagttatctactttgctgcgtatatcgtaattgatccaggtgatactgaccttgaacctaagcaattgttaactgaagctgaatatcgtgaacaaaaagcaaaatacggtaatcgctttgaagctaagatgggtgctgaagctattcgtgaattgcttaagaaggttgaccttgataaagaagttaagaatttgaagaaagaacttcaaactgcaactggtcaaaagcgtactcgtgcaattagacgtttagatattttggatgcatttaagaattctggtaacaaacctgaatggatggttatggatgctgttccagttatcccaccagatcttcgtccaatggttcaacttgaaggtggacgttttgcaacttcagatttgaacgatttatatagacgtgtcattaaccgtaataatcgtttgaagagattacttgacttgaatgctccaaatattatcgttcaaaatgaaaagcgtatgcttcaagaagctgtagatgctttgatcgataatggacgtcgtggtcgtcctgttgttggaccaggtaaccgtccacttaagtcactttcacacatgcttaaaggtaagcaaggtcgtttccgtcaaaacttgcttggtaagcgtgtagactattctggtcgttcagttattgatgtttcaccaaaattgaagttctatcaatgtggtgttcctcgtccaatggctttggaattgtttaagccatttgtaatgcacgaattggttaagcgtggtattgcttctaacattaagaatgctaagcgtaagattgatcgtgaagatgatgatatctgggacgtacttgaagacgttattaaggaacgtccagttcttttaaaccgtgcacctactcttcaccgtttgagtattcaagcatttgaacctgttttggtaccaggtaaatcaattagacttcacccattagcttgtgaagcttacaatgccgacttcgatggtgaccagatggccatccacgtaccactttcagatgaagctgttgctgaatcacgtttgcttatgcttgcagctcaccatatcttagctcctaaggatggtaagccaattgttactccatcacaggatgttgttttgggtaactactggttaactcaagctgaacgtggccgtgaaggcgaaggcatgatctttagttcaccagcagaagcaactgtagcttacgaaaatggtgatattcactatcatactattattggtatgtcagctgatgctatgcctaagaagccatggcctaagggacacgaacatggtattttcattactacttacggtaagcttgtctttaatcaattgttcccagacgattacttttatgtcaatgaaccaactgagaagaacttgaatgatccattggatgctaagtacttcttaaatgaaggtgaagatattaatagtaaaatcaatgaagtggctgatgatttgatcgctagtccattcaagagtagcttcttatcagattcaattgctactatttacaagtattacaaggttcaaagaacttcagaatacttggatgacttgaaggaattaggttacactagttcaactacttcaggtattactattggtatgaatgacgttcctgaaattggtgataaagatgaaaaggtagctaaagcacgtaagcaagttgatgttgtttctaaacaatttagacgtggtttaattactgaacaagaacgtcacgatcgagtaattagtatttggaatgcatgtaaggatgaaatccaaaacgaaattgctcaaatccactcaccacgtaacccaatttcaatcatggccgactcaggtgcccgtggtaacatttctaactttactcagttagctggtatgcgtggattgatggccactcctaacggtggtttgttcgaaattcctgttacttcaaactttaaagaaggtttgtcagtattggaattgttcatgtccactcacggtgctcgtaagggtatgactgatacagctttgaagactgctcagtcaggttacttaactcgtcgtttggttgatgttgcacaggatgttattattcgtgatgatgattgtggtactgatagaggtattacagttagtgcaattatggaaggcgacgaaatgattgaaccattattcgatcgtttagttggtcgtttcactgctgaaactgttaaggatcctgagactggtgaagcaatcgttggtagagacgtaatgatggacgaaaacatggctcataagatctgtgatgcaggtgtaactcatgttaagattcgttcaatccttacttgtgataccccacacggtgtatgtcgtaagtgttacggtatgaaccttgctactggtgaagaagttgaagttggtgaagcagttggtactgttgcagcacaatcaattggtgaaccaggtactcagcttactttgagaactttccacaacggtggggttgccggtgctgaagatattactcaaggtttgcctcgtgttcaagaattgtttgaagcacgtaaccctaagggtcgtgcaaccatttctgaagtagatggtgtaattgattcaattcaagaaaatccagcagaacatactcgtgaaattactgttaagggtaaaattgatactagaagttacagtgttccttatactgcttcagttgctgtatctgagggtgattatgttcaccgtggtgataagttaactcttggttctgttgaccctaaggaattaatccaagttactgatactttaactactgagaagtatattttggctgaagttcaaaaggcctacagaatgcagggtgtagatatcgctgacaagcacgtcgaagtattgactcgtcaaatgcttcaaaaggttcgtgttcttgatccgggtgaaactgacatcttaccaggtgaagttatggatatcggtcaatttagagaccgtaataaggaagtaattatctctggtggtattcctgcaactgctcaaagtattatcttaagtattactaaggctgctttggaaactaacagtttcttgtcagctgcttcattccaagaaactactcgtgttcttactgatgcttcaatcagaggtaagaatgatccgcttcttggtcttaaggaaaatgttatcatcggtaaaattattccagctggtactggtatgccaatttaccgtagcatggaacctgaagctgatgttaagaaaccagattcagtatactcaattgctgatattgaaaagcaaatgaaagaaaaagataagactaag

SEQ ID NO: 150 - protein, 1217 aa, Lactobacillus acidophilus
MIDVNKFESMQIGLASPNKIRSWSYGEVKKPETINYRTLKPEKDGLFDERIFGPTKDWSCACGKYKGVRYRGIVCDRCGVEVTSSKVRRERMGHIELAAPVTHIWYFKGIPSRMGLVLDISPRLLEEVIYFAAYIVIDPGDTDLEPKQLLTEAEYREQKAKYGNRFEAKMGAEAIRELLKKVDLDKEVKNLKKELQTATGQKRTRAIRRLDILDAFKNSGNKPEWMVMDAVPVIPPDLRPMVQLEGGRFATSDLNDLYRRVINRNNRLKRLLDLNAPNIIVQNEKRMLQEAVDALIDNGRRGRPVVGPGNRPLKSLSHMLKGKQGRFRQNLLGKRVDYSGRSVIDVSPKLKFYQCGVPRPMALELFKPFVMHELVKRGIASNIKNAKRKIDREDDDIWDVLEDVIKERPVLLNRAPTLHRLSIQAFEPVLVPGKSIRLHPLACEAYNADFDGDQMAIHVPLSDEAVAESRLLMLAAHHILAPKDGKPIVTPSQDVVLGNYWLTQAERGREGEGMIFSSPAEATVAYENGDIHYHTIIGMSADAMPKKPWPKGHEHGIFITTYGKLVFNQLFPDDYFYVNEPTEKNLNDPLDAKYFLNEGEDINSKINEVADDLIASPFKSSFLSDSIATIYKYYKVQRTSEYLDDLKELGYTSSTTSGITIGMNDVPEIGDKDEKVAKARKQVDVVSKQFRRGLITEQERHDRVISIWNACKDEIQNEIAQIHSPRNPISIMADSGARGNISNFTQLAGMRGLMATPNGGLFEIPVTSNFKEGLSVLELFMSTHGARKGMTDTALKTAQSGYLTRRLVDVAQDVIIRDDDCGTDRGITVSAIMEGDEMIEPLFDRLVGRFTAETVKDPETGEAIVGRDVMMDENMAHKICDAGVTHVKIRSILTCDTPHGVCRKCYGMNLATGEEVEVGEAVGTVAAQSIGEPGTQLTLRTFHNGGVAGAEDITQGLPRVQELFEARNPKGRATISEVDGVIDSIQENPAEHTREITVKGKIDTRSYSVPYTASVAVSEGDYVHRGDKLTLGSVDPKELIQVTDTLTTEKYILAEVQKAYRMQGVDIADKHVEVLTRQMLQKVRVLDPGETDILPGEVMDIGQFRDRNKEVIISGGIPATAQSIILSITKAALETNSFLSAASFQETTRVLTDASIRGKNDPLLGLKENVIIGKIIPAGTGMPIYRSMEPEADVKKPDSVYSIADIEKQMKEKDKTK

SEQ ID NO: 151 - DNA, 636 bp, Lactobacillus acidophilus
  CDS (1)..(636): ribosomal Protein, ORF# 291
atgaccaaaggaatcttaggaagaaaagttggtatgactcaaatctttactaaagatggtatccttgttcctgtaactgttgttgaagcaactcctaacgttgttatgcaagttaagactgttgaatcagacggttacgaagcagttcaattaggttaccaagacaaacgtgaagttttgagcaacaaaccagaaaaaggtcatgctgataaagcaaagacttcacctaagcgcttcattcgggaaatccgcggtgttgagcttaaggactatgaagtcggctcagaagttactgtggatacattcaaggaaggtgacgttgtaaacgttactggtacttcaagaggtcatggataccaaggtaacattaagcgttggggccaatcaagaggaccagaaactcacggttcaagataccacagaattcctggttcaatgggttcaatcattaaccgtgtaccaaagggcaagcgtttgccaggtcacatgggtgtaaagaaagttaccattgaaaacttagtaattgaaaaagttgttgcagataagaacgtattgatgatcaagggtaatgttcctggtgctaagaactcattaatcgttgttaagactgcttctaaagctgttaaggctgataaa

SEQ ID NO: 152 - protein, 212 aa, Lactobacillus acidophilus
MTKGILGRKVGMTQIFTKDGILVPVTVVEATPNVVMQVKTVESDGYEAVQLGYQDKREVLSNKPEKGHADKAKTSPKRFIREIRGVELKDYEVGSEVTVDTFKEGDVVNVTGTSRGHGYQGNIKRWGQSRGPETHGSRYHRIPGSMGSIINRVPKGKRLPGHMGVKKVTIENLVIEKVVADKNVLMIKGNVPGAKNSLIVVKTASKAVKADK

SEQ ID NO: 153 - DNA, 546 bp, Lactobacillus acidophilus
  CDS (1)..(546): ATP synthase subunit delta, ORF# 775
atggctttaagtagagaagaagtagctgcgcgctatggtaccgctttgttcggttatgcgcaagataataaagtgttggacacagtttatgatgaaatgatggctttaaaaaaggcagcaattgctaatcctaaattcatcagtgtcctaagtgatcctattttaagtagtaaagataaaaagtctattttgactgctgttgaaaaagatttttcagatgaagtacaaggctttttgaatttattacttgaatataatcgctttgctgatttgattgatattattgatcaatttagtttactttatgataatgaaaataagattgcatctggtactgcaactactgcagtgaagctagatgatgatcaacttgagcgtttaagtgaaagctttgctaagaagtacgatttaaacgcagtgcgtcttgagaataaagttgatccaagtatattaggcggcgtgattcttcaagttaaggatcgcgtgattgatggatcagttaaaaataaactgaagaagatccgtgcgcaaataattgatgaaaat

SEQ ID NO: 154 - protein, 182 aa, Lactobacillus acidophilus
MALSREEVAARYGTALFGYAQDNKVLDTVYDEMMALKKAAIANPKFISVLSDPILSSKDKKSILTAVEKDFSDEVQGFLNLLLEYNRFADLIDIIDQFSLLYDNENKIASGTATTAVKLDDDQLERLSESFAKKYDLNAVRLENKVDPSILGGVILQVKDRVIDGSVKNKLKKIRAQIIDEN

SEQ ID NO: 155 - DNA, 1293 bp, Lactobacillus acidophilus
  CDS (1)..(1293): protein translocase, ORF# 311
atgttttcgaccttgaagaacgcctttaaggataaagaaattagaaataaaatttatttcactctttttattcttttaatatacaggattggtgctaatattaccgttcctggtgttaatgcaaaggcgatcacacaggttgctcaaactggattagttccaatgctggatactgtatccggtggtggactagataactattcaatattttcattgggtgtttccccgtatattacggcgcagatcgtaattcaacttttacaaatggatattgttccgacattagtcgaatgggggaagcaaggggaagttggtagacgtaaaaccaatcaagtaacaaggtatttaactttagttgttgcttttgttcaaagtattggtattacgttaggattcaacgccttaactcaaatggggttagttaaaaatcaaacaccccagacttatgtagaaattgccattattatgactgctggaacgatgttattaacatggttaggtgatgaaatcactgataagggtcttggaaatggtgtatcagtaattatttttgctggtattattgcaagattaccaagtggcttatggcaaatttacaaagaagaaattattaacaatagtgccagtgatcgttggcaaggtattttgttcttcatcgcggttatagttgcaatccttatcgtaactcaattagttacgtgggttgaacaggctgatcgtcgcattcccattcaatatacaagaagagcgacgattagtggttctgaaagttttctaccattaaaagttaatgtatctggggttattccagttatttttgccagttcatttattattacgccggcaacaattttaatggcctttcaaagaacccaaggcgatcaacaatggtttaaagtattgaatcaaatctttagtttacaaactactcctggtgttatcatctacactcttttaattattttatttactttcttctacgcttttgttcaggttaaccctgagaagctagcagaaaacttacaaaaacagggtgcttatattcctagcgtttggccaggtaaagatacacagaattatatttcaaagatgttgatcaagttatcaactgtaggttcaatatttttaggtttagttgctctattgcctcaattggctactaacttttggaatctcccaagttccattggtttaggaggaacaagtcttttaattgtgattggggttgttcttgagttatctcgtcaaattaacggcttgttaatgaagagagaatatgttggattcatcaga

SEQ ID NO: 156 - protein, 431 aa, Lactobacillus acidophilus
MFSTLKNAFKDKEIRNKIYFTLFILLIYRIGANITVPGVNAKAITQVAQTGLVPMLDTVSGGGLDNYSIFSLGVSPYITAQIVIQLLQMDIVPTLVEWGKQGEVGRRKTNQVTRYLTLVVAFVQSIGITLGFNALTQMGLVKNQTPQTYVEIAIIMTAGTMLLTWLGDEITDKGLGNGVSVIIFAGIIARLPSGLWQIYKEEIINNSASDRWQGILFFIAVIVAILIVTQLVTWVEQADRRIPIQYTRRATISGSESFLPLKVNVSGVIPVIFASSFIITPATILMAFQRTQGDQQWFKVLNQIFSLQTTPGVIIYTLLIILFTFFYAFVQVNPEKLAENLQKQGAYIPSVWPGKDTQNYISKMLIKLSTVGSIFLGLVALLPQLATNFWNLPSSIGLGGTSLLIVIGVVLELSRQINGLLMKREYVGFIR

SEQ ID NO: 157 - DNA, 510 bp, Lactobacillus acidophilus
  CDS (1)..(510): ribosomal Protein, ORF# 369
ttgagtaaagctgctattgctgaaaaggaaaagctcgttgatgcatttgctgaagaacttaaagctgctaaggctatcttagtaatcaactaccttggtttaactgttgaagaagttactaacatgcgtaaggatcttcgtgataacgatgttaagatgaaggttatcaagaatacttacttaagacgtgctgctgctaaggctggtatcgaaggtcttgatgatacttttgtaggtcctactgctgttatctacactgataacgctgatgatatcactgaaccagctcgtatcgtttctaagtacgaagacgatttcgatgttatcgaaatcaagggtggtatgcttgaaggtaagttgacttctaaggaagaaatcaaggaacttgcttcaattccaggccgcgaaggtttgctttcaatgcttgtttctgtattgcaagctcctgtccgcgacttcgcttatgctgttaaggctgttgctgaatctaaggatgaagactcagctgaa

SEQ ID NO: 158 - protein, 170 aa, Lactobacillus acidophilus
MSKAAIAEKEKLVDAFAEELKAAKAILVINYLGLTVEEVTNMRKDLRDNDVKMKVIKNTYLRRAAAKAGIEGLDDTFVGPTAVIYTDNADDITEPARIVSKYEDDFDVIEIKGGMLEGKLTSKEEIKELASIPGREGLLSMLVSVLQAPVRDFAYAVKAVAESKDEDSAE

SEQ ID NO: 159 - DNA, 294 bp, Lactobacillus acidophilus
  CDS (1)..(294): ribosomal Protein S6, ORF# 7
atggcaactacaaagtacgaagtaacttacattatcaagcctgatatcgatgaagataacaagaaggctctcgtagaaaactacgacaaggttatcgctgataacggtggtactatggtagaatccaaagactggggcaagcgtcgtttcgcatatgaaattgataagtatcgtgaaggtacttaccacattatgactttcactgctgacaacgctgacgcagttaacgaatttagccgtttgtcaaagatcgacaacgctatcttgcgttcaatgaccgttaagttagacaag

SEQ ID NO: 160 - protein, 98 aa, Lactobacillus acidophilus
MATTKYEVTYIIKPDIDEDNKKALVENYDKVIADNGGTMVESKDWGKRRFAYEIDKYREGTYHIMTFTADNADAVNEFSRLSKIDNAILRSMTVKLDK

SEQ ID NO: 161 - DNA, 936 bp, Lactobacillus acidophilus
  CDS (1)..(936): RNA polymerase, ORF# 317
atgattgaatttgaaaaaccaaatattaccgttgttgaacaagaagattcttacggtaagtttgttgttgaaccacttgagcgaggctttggtactactttaggtaattctttaagaagagtattacttacttctattccgggtactggacttgtttatgtgcaaattgatggcgttttacacgagttctcaacagttcctggcgttagagaagatgtaaccaaaatcattttgaatttaaagaagcttgaattaaagtctctttcagatgaacaaaaggttattgaattagacgttgaaggtcctgccacagtgactgctgatgatcttaaagttgatgcagatgttcaagtcttaaatccagatcaatatatttgtaccattgctgaaggtggacacttgcacatggaactcgccgtaaaaaatggtagaggatacgttgcagcaagtgacaataagagtgatgatatgccaatcggagtaattcctgttgattctctattctcaccaattaaaaaggttaattaccaagttgaatcaactcgtgttggtaagagagacgattttgacaaactcacttttgagatttggactgacggttcaatcaagcctaatgacgcccttagttttgctgctaaaattttagttgaacatttcaaggtgtttgaatcagctgatgcaaatactaaattcagcgaagtaatggtggaaaaggaagacgataagaaagaaaagaagctcgaaatgacaattgaagaacttgatctttctgttcgttcatataactgcctgaaacgtgctggcattaacactcttcaagagttgactgataagacagaatcagatatgatgcgtgtacgtaacttaggacgtaaatcattggaagaagtaaagaataaattaactgacttaggtctttcacttcgtcaagaagac

SEQ ID NO: 162 - protein, 312 aa, Lactobacillus acidophilus
MIEFEKPNITVVEQEDSYGKFVVEPLERGFGTTLGNSLRRVLLTSIPGTGLVYVQIDGVLHEFSTVPGVREDVTKIILNLKKLELKSLSDEQKVIELDVEGPATVTADDLKVDADVQVLNPDQYICTIAEGGHLHMELAVKNGRGYVAASDNKSDDMPIGVIPVDSLFSPIKKVNYQVESTRVGKRDDFDKLTFEIWTDGSIKPNDALSFAAKILVEHFKVFESADANTKFSEVMVEKEDDKKEKKLEMTIEELDLSVRSYNCLKRAGINTLQELTDKTESDMMRVRNLGRKSLEEVKNKLTDLGLSLRQED

SEQ ID NO: 163 - DNA, 540 bp, Lactobacillus acidophilus
  CDS (1)..(540): ribosomal Protein, ORF# 303
atggcaagttatttagctgaagaatacaaagaaacagtagctcctgctttaaaggaaaagtttaactacacttcatcaatgcaaattcctaagatcgataagatcgttttaaacatgggtgttggtgatgcagtatcaaatgccaagaacttggacgaagctgttgaagaattaactttgatttcaggccaaaagcctttgattactaaggctaagaagtcaatcgctaacttccgtttacgtgaaggtatgtctatcggtgctaaggttactcttagaggcgacagaatgtacgacttcttgtacaagttaatcaatgtttctcttccacgtgttcgtgacttccgtggtgtatcaactcgttcatttgatggtcgcggtaattacactttgggtattaaggaacaattaattttcccagaaattgattttgataaggttaaccgtactagagggttagacattgttatcgtaactactgccgatactgatgaagaagctcgtgaacttttaagtcaattcggtatgccgtttgcaaga

SEQ ID NO: 164 - protein, 180 aa, Lactobacillus acidophilus
MASYLAEEYKETVAPALKEKFNYTSSMQIPKIDKIVLNMGVGDAVSNAKNLDEAVEELTLISGQKPLITKAKKSIANFRLREGMSIGAKVTLRGDRMYDFLYKLINVSLPRVRDFRGVSTRSFDGRGNYTLGIKEQLIFPEIDFDKVNRTRGLDIVIVTTADTDEEARELLSQFGMPFAR

SEQ ID NO: 165 - DNA, 528 bp, Lactobacillus acidophilus
  CDS (1)..(504): ribosomal Protein, ORF# 305
atgagccgtattggtttaaagactattgaagtccctgacagtgtcactgttaccaaggaaggtgacaatattactgttaagggccctaagggtgaattaactagatactttgatccaaagatcacttttgaacaaaatgatggcgaaattaacttttcacgttcaagtgaaagtgacaaagcacttcacggtactgaaagagctaacttagcttcaatgatcgaaggtgtacttaatggttacaagaagactttgaagttaatcggtgttggttaccgtgcacaagcacaaggtaataagattactttaaatgttggttactcacacccagttgtattgactgcaccagaaggtgtttctgtaaaggcaacttcagcaactgatgtagaagttgaaggtgtttcaaagcaagatgtaggtcaatttgcagctgaaatccgcgccgtacgtccaccagaaccttataagggtaagggtattcgttatgttgatgaatacgtacgtcgtaaggaaggtaagactggtaag

SEQ ID NO: 166 - protein, 168 aa, Lactobacillus acidophilus
MSRIGLKTIEVPDSVTVTKEGDNITVKGPKGELTRYFDPKITFEQNDGEINFSRSSESDKALHGTERANLASMIEGVLNGYKKTLKLIGVGYRAQAQGNKITLNVGYSHPVVLTAPEGVSVKATSATDVEVEGVSKQDVGQFAAEIRAVRPPEPYKGKGIRYVDEYVR

SEQ ID NO: 167 - DNA, 504 bp, Lactobacillus acidophilus
  CDS (1)..(504): ribosomal Protein, ORF# 307
atggcaaaccgcaatgattctcgtaacaatcgcagaaacaaagacgatatcgaagatcaattagtcgctgtcaaccgtattactaaggttgttaaaggtggccgtcgcatgagatttgctgctcttgttgttgttggtgacaagaagggccgcgtaggttttggtactggtaaagctcaagaagtcccagaagcaatccgtaaggctgtagaagacggtaagaagaagatgatcaacgtacctaaggttggtactactattcctcacgaagttattggtcactatggttcaggtaacattttattgaagcctgccgaagctggttccggtgttgctgccggtggtgccgtacgtatcgttatggatatggctggtatttcagacgtaacttcaaagtcacttggttctaatactccaatcaacgttgttcgtgcaactattgatggtttaaagaagcttagaactagcgaagaagtaagtaaacttcgtcaacctgaaagagct

SEQ ID NO: 168 - protein, 168 aa, Lactobacillus acidophilus
MANRNDSRNNRRNKDDIEDQLVAVNRITKVVKGGRRMRFAALVVVGDKKGRVGFGTGKAQEVPEAIRKAVEDGKKKMINVPKVGTTIPHEVIGHYGSGNILLKPAEAGSGVAAGGAVRIVMDMAGISDVTSKSLGSNTPINVVRATIDGLKKLRTSEEVSKLRQPERA

SEQ ID NO: 169 - DNA, 543 bp, Lactobacillus acidophilus
  CDS (1)..(543): adenine phosphoribosyltransferase, ORF# 1242
ttggaggtttttcttcttatggcaattgattttagtaagtatattgcaagtgttcaggactttcctaataaggggatagttttccgtgatattacacctattttgcaaaatggcgaattatatcgtgcagccacacatgaattagctgaatacgcaaagagtagaaatgcagatgtaattgtcggtcctgaagcacgtggctttattgtaggctgtccagtagcaactgaattgggtttgggctttgttccagctagaaaaccacataagttgccacgagaagttgaacgtgcttcatacgatttggaatatgggtccaacagtttggaaatgcataaagatgcaatcaagccaggacaacgagtagttctttgtgatgatttaatggctactgcgggtactttaagagcttctaaagaattaattgaaaatcttggaggcaaacttgttggtgctgcattctatattgaattgccagatttaaaaggtagagaaaaattaccagacgttgatatttactcacttgttaagtatcacggtgct

SEQ ID NO: 170 - protein, 181 aa, Lactobacillus acidophilus
MEVFLLMAIDFSKYIASVQDFPNKGIVFRDITPILQNGELYRAATHELAEYAKSRNADVIVGPEARGFIVGCPVATELGLGFVPARKPHKLPREVERASYDLEYGSNSLEMHKDAIKPGQRVVLCDDLMATAGTLRASKELIENLGGKLVGAAFYIELPDLKGREKLPDVDIYSLVKYHGA

SEQ ID NO: 171 - DNA, 1002 bp, Lactobacillus acidophilus
  CDS (1)..(1002): Sucrose operon repressor ORF# 500
atgatagttatgaaaggaaataaaaatatggcaacaatgaaagacgttgctcaaagagcaggagttggtgtcggtacagtctctagagtaattaaccatgtaccaggggttaagaaaagtactttagtgaaagttaaagaggcaattaaggaattaaattatattcctgatgagtatgccaggggattaaaaacaaaatcttctagaacaattgcacttattttgccatctatctggcatccattcttttctgaatttgcatattatgtagaaaagagattatacaaggaagattacaagctcttattatgtaattcaaacagagatccaaaagaagaagctaaatatataaagatgcttaagcaaaataaaattgatgcgattatcgctattacatatagtgatattggtcaatatatttattccaacattccttttgttagcttagatcgttattttgagaaaaaagtatcgtatgttacgtcagacaactacgaaggtggaaaattagcggcaaaggagttattagctcatggtgctaaaaatattgcatatataggcagccatagtaaatatcctaatgctactatgctacgaaaagatggttttgatgattatcttaaagaacatgacataaactacaaggaaatattcttacatgaaccagtgcctgaggctgattttattaatcatcttttagaaatgttaactgcacatcctgaaattgatgggattttttgtcatacggattctttgttattaacgttaagaaaagctttaatccaacatggttatcgtgtgcctgaagatatacaattaattggctttgatggtattaaaatggattcggctcattctttaggtatatctacaattgcacaacctgttgaaaaattggcaaatggagcggtggatttagttttaaagaagatagcagatcctagtgtaaaaaatgaagctaaaatgtatccagtaaaatatataaatggcaataccacaaaa

SEQ ID NO: 172 - protein, 334 aa, Lactobacillus acidophilus
MIVMKGNKNMATMKDVAQRAGVGVGTVSRVINHVPGVKKSTLVKVKEAIKELNYIPDEYARGLKTKSSRTIALILPSIWHPFFSEFAYYVEKRLYKEDYKLLLCNSNRDPKEEAKYIKMLKQNKIDAIIAITYSDIGQYIYSNIPFVSLDRYFEKKVSYVTSDNYEGGKLAAKELLAHGAKNIAYIGSHSKYPNATMLRKDGFDDYLKEHDINYKEIFLHEPVPEADFINHLLEMLTAHPEIDGIFCHTDSLLLTLRKALIQHGYRVPEDIQLIGFDGIKMDSAHSLGISTIAQPVEKLANGAVDLVLKKIADPSVKNEAKMYPVKYINGNTTK

SEQ ID NO: 173 - DNA, 249 bp, Lactobacillus acidophilus
  misc_feature (1)..(204): Upstream region to msmE ORF# 502
  misc_feature (109)..(123): cre2 sequence
  misc_feature (176)..(190): cre1 sequence
taactgttgacaagttgtgaaagcgatattatcatttaattgtaaattgaaaacgtttccaaagtgttcaaatagttttttgctaaataattatttttttgtagcgaaatagaaacgtttcaattaatttaaaacaattagatcttagtaggaaaccttttaatttttgtgcaaaattgaaacgtttcaaaaggaggaaaaatgaaaaaatggaaattaggagttgcagccattgcaactgtcgcagct

SEQ ID NO: 174 - DNA, 15 bp, Lactobacillus acidophilus
  misc_feature (1)..(15): cre1 sequence upstream of msmE
attgaaacgtttcaa

SEQ ID NO: 175 - DNA, 15 bp, Lactobacillus acidophilus
  misc_feature (1)..(15): cre2 sequence upstream of msmE
atagaaacgtttcaa

SEQ ID NO: 176 - DNA, 15 bp, Bacillus subtilis
  misc_feature (4)..(4): n is a, c, g, or t
  misc_feature (7)..(7): n is a, c, g, or t
  misc_feature (10)..(10): n is a, c, g, or t
  misc_feature (12)..(13): n is a, c, g, or t
wtgnaancgnwnncw

SEQ ID NO: 177 - DNA, 18 bp, Bacillus subtilis
  misc_feature (5)..(5): n is a, c, g, or t
  misc_feature (11)..(11): n is a, c, g, or t
wwtgnaarcgnwwwcaww

SEQ ID NO: 178 - DNA, 14 bp, Bacillus subtilis
  misc_feature (6)..(6): n is a, c, g, or t
  misc_feature (9)..(9): n is a, c, g, or t
  misc_feature (11)..(11): n is a, c, g, or t
tgwaancgntnwca

SEQ ID NO: 179 - DNA, 14 bp, Bacillus subtilis
tgtaagcgcttaca

SEQ ID NO: 180 - DNA, 14 bp, Bacillus subtilis
tgtaaacgttatca

SEQ ID NO: 181 - DNA, 15 bp, Lactobacillus acidophilus
attgaaacgtttcaa

SEQ ID NO: 182 - DNA, 15 bp, Lactobacillus acidophilus
atagaaacgtttcaa

SEQ ID NO: 183 - DNA, 15 bp, Streptococcus pneumoniae
aatgaaacgtttcaa

SEQ ID NO: 184 - DNA, 15 bp, Streptococcus pneumoniae
aatgaaacgtttcaa

SEQ ID NO: 185 - DNA, 17 bp, Lactobacillus acidophilus
aataaaagcgtttacat

SEQ ID NO: 186 - DNA, 17 bp, Lactobacillus acidophilus
tatgaaagcgcttaaaa

SEQ ID NO: 187 - DNA, 14 bp, Staphylococcus mutans
agatagcgatttgg

SEQ ID NO: 188 - DNA, 14 bp, Staphylococcus mutans
agatagcgcttaca

SEQ ID NO: 189 - DNA, 20 bp, Artificial
  Oligonucleotide primer
gtaataatagtcaaagtggc

SEQ ID NO: 190 - DNA, 30 bp, Artificial
  Oligonucleotide primer
gatcggatccaagatcaatgctgctttaaa

SEQ ID NO: 191 - DNA, 20 bp, Artificial
  Oligonucleotide primer
ggaaggctgaagtagtttgc

SEQ ID NO: 192 - DNA, 31 bp, Artificial
  Oligonucleotide primer
gatcgaattcgatacaggatatggcattacg

SEQ ID NO: 193 - DNA, 25 bp, Artificial
  Oligonucleotide primer
aggatccatccatatgctccacact

SEQ ID NO: 194 - DNA, 25 bp, Artificial
  Oligonucleotide primer
agaattcaacatgatcagcacttct

SEQ ID NO: 195 - DNA, 20 bp, Artificial
  Oligonucleotide primer
ggaatatcttcggctaattg

SEQ ID NO: 196 - DNA, 25 bp, Artificial
  Oligonucleotide primer
ccacttcaagtagctgttactaata

SEQ ID NO: 197 - DNA, 20 bp, Artificial
  Oligonucleotide primer
cttgagtaagatacttttgg

SEQ ID NO: 198 - DNA, 20 bp, Artificial
  Oligonucleotide primer
gaccagaagatattcacgcc

SEQ ID NO: 199 - DNA, 20 bp, Artificial
  Oligonucleotide primer
acctggcttgtgataatcac

SEQ ID NO: 200 - DNA, 20 bp, Artificial
  Oligonucleotide primer
ggtctttgaacttgttccgc

SEQ ID NO: 201 - protein, 5 aa, Artificial
  Anchoring motif
LSLTG

SEQ ID NO: 202 - protein, 9 aa, Artificial
  Walker A motif
GPSGCGKST

SEQ ID NO: 203 - protein, 9 aa, Artificial
  Walker A consensus motif
  misc_feature (2)..(3): Xaa can be any naturally occurring amino acid
  misc_feature (5)..(5): Xaa can be any naturally occurring amino acid
GXXGXGKST

SEQ ID NO: 204 - protein, 10 aa, Artificial
  Walker A consensus motif
  misc_feature (3)..(6): Xaa can be any naturally occurring amino acid
AGXXXXGKST

SEQ ID NO: 205 - protein, 12 aa, Artificial
  Walker B motif
IFLMDEPLSNLD

SEQ ID NO: 206 - protein, 8 aa, Artificial
  Walker B consensus motif
  MISC_FEATURE (1)..(4): Xaa may be any hydrophobic amino acid
XXXXDEPT

SEQ ID NO: 207 - protein, 8 aa, Artificial
  Walker B consensus motif
  misc_feature (3)..(7): Xaa can be any naturally occurring amino acid
DEXXXXXD

SEQ ID NO: 208 - protein, 4 aa, Artificial
  ABC signature sequence
LSGG

SEQ ID NO: 209 - protein, 6 aa, Artificial
  Linton and Higgins motif
IAKLHQ

SEQ ID NO: 210 - protein, 6 aa, Artificial
  Linton and Higgins consensus motif
  MISC_FEATURE (1)..(4): Xaa may be any hydrophobic amino acid
  MISC_FEATURE (6)..(6): Xaa may be any charged amino acid
XXXXHX

SEQ ID NO: 211 - protein, 17 aa, Artificial
  Conserved beta-fructosidase motif
  misc_feature (2)..(3): Xaa can be any naturally occurring amino acid
  misc_feature (5)..(8): Xaa can be any naturally occurring amino acid
HXXPXXXXLIVMNDPNG

SEQ ID NO: 212 - protein, 5 aa, Artificial
  Conserved beta-fructosidase motif
NDPNG

SEQ ID NO: 213 - protein, 4 aa, Artificial
  Conserved beta-fructosidase motif
FRDP

SEQ ID NO: 214 - protein, 5 aa, Artificial
  Conserved beta-fructosidase motif
  misc_feature (3)..(3): Xaa can be any naturally occurring amino acid
LPXTG

SEQ ID NO: 215 - protein, 21 aa, Artificial
  LacI consensus
TIKDVARLAGVSKSTVSRVLN

SEQ ID NO: 216 - protein, 24 aa, Bacillus halodurans
MATIKDIAKLANVSNATVSRVLNR

SEQ ID NO: 217 - protein, 24 aa, Bacillus subtilis
MVRIKDIALKAKVSSATVSRILNE

SEQ ID NO: 218 - protein, 24 aa, Klebsiella pneumoniae
RVTIKDIAELAGVSKATASLVLNG

SEQ ID NO: 219 - protein, 24 aa, Salmonella typhimurium
RVTIKDIAEQAGVSKATASLVLNG

SEQ ID NO: 220 - protein, 24 aa, Pasteurella multocida
RITLSDIAKCCGLSTTTVSMILNN

SEQ ID NO: 221 - protein, 24 aa, Clostridium beijerinckii
KVTIQDIANMVNVSKSSVSRYLNN

SEQ ID NO: 222 - protein, 24 aa, Clostridium perfringens
KVTIQDIANMVGVSKSTVSRYLNG

SEQ ID NO: 223 - protein, 24 aa, Bacillus halodurans
MTTILDIAKLAGVAKSTVSRYLNG

SEQ ID NO: 224 - protein, 24 aa, Staphylococcus aureus
MKNISDIAKLAGVSKSTVSRFLNN

SEQ ID NO: 225 - protein, 24 aa, Staphylococcus xylosus
MKNIADIAKIAGVSKSTVSRYLNN

SEQ ID NO: 226 - protein, 24 aa, Enterococcus faecalis
VAKLTDVAELAGVSPTTVSRVINN

SEQ ID NO: 227 - protein, 24 aa, Streptococcus pyogenes
VAKLTDVAALAGVSPTTVSRVINK

SEQ ID NO: 228 - protein, 24 aa, Streptococcus agalactiae
VAKLTDVAALAGVSPTTVSRVINK

SEQ ID NO: 229 - protein, 24 aa, Staphylococcus mutans
VAKLTDVAKLAGVSPTTVSRVINR

SEQ ID NO: 230 - protein, 24 aa, Streptococcus pneumoniae
VAKLTDVAKLAGVSPTTVSRVINK

SEQ ID NO: 231 - protein, 24 aa, Enterococcus faecalis
VVKLTDVAKLAGVSPTTVSRVINN

SEQ ID NO: 232 - protein, 24 aa, Lactobacillus lactis
MIKLEDVANKAGVSVTTVSRVINR

SEQ ID NO: 233 - protein, 24 aa, Lactobacillus acidophilus
PAKLSDVAREAGCSVTTVSRVINN

SEQ ID NO: 234 - protein, 24 aa, Lactobacillus gasseri
MVKLTDVAAKAGCSVTTVSRVINN

SEQ ID NO: 235 - protein, 24 aa, Lactobacillus plantarum
KPKLNDVAKLAGVSATTVSRVINN

SEQ ID NO: 236 - protein, 24 aa, Pediococcus pentosaceus
KPKLNDVAKLAGVSATTVSRVINN

SEQ ID NO: 237 - protein, 24 aa, Lactobacillus acidophilus
MATMKDVAQRAGVGVGTVSRVINH

SEQ ID NO: 238 - protein, 24 aa, Streptococcus pneumoniae
SITMKDVALEAGVSVGTVSRVINK

SEQ ID NO: 239 - protein, 22 aa, Vibrio alginolyticus
SLHDVARLAGVSKSTVSRVIND

SEQ ID NO: 240 - protein, 24 aa, Escherichia coli
MASLKDVARLAGVSMMTVSRVMHN

SEQ ID NO: 241 - protein, 24 aa, Bifidobacterium longum
MVTMKEIANKAGVSVSTVSLVLNG

SEQ ID NO: 242 - protein, 24 aa, Ralstonia solanacearum
RPTIRDVATLAGVSTSTVSRVLNN

SEQ ID NO: 243 - protein, 5 aa, Artificial
  Consensus sequence
NDPNG

SEQ ID NO: 244 - protein, 8 aa, Lactobacillus acidophilus
WINDPNGL

SEQ ID NO: 245 - protein, 8 aa, Streptococcus pneumoniae
WINDPNGF

SEQ ID NO: 246 - protein, 8 aa, Escherichia coli
WMNDPNGL

SEQ ID NO: 247 - protein, 8 aa, Bifidobacterium longum
WINDPNGL

SEQ ID NO: 248 - protein, 8 aa, Pasteurella multocida
LLNDPNGL

SEQ ID NO: 249 - protein, 8 aa, Vibrio alginolyticus
LLNDPNGL

SEQ ID NO: 250 - protein, 8 aa, Lactobacillus acidophilus
LINDPNGF

SEQ ID NO: 251 - protein, 8 aa, Lactobacillus gasseri
LLNDPNGF

SEQ ID NO: 252 - protein, 8 aa, Streptococcus mutans
LLNDPNGF

SEQ ID NO: 253 - protein, 8 aa, Streptococcus sobrinus
LLNDPNGF

SEQ ID NO: 254 - protein, 8 aa, Enterococcus faecalis
LLNDPNGF

SEQ ID NO: 255 - protein, 8 aa, Streptococcus pneumoniae
LLNDPNGF

SEQ ID NO: 256 - protein, 8 aa, Streptococcus agalactiae
LLNDPNGH

SEQ ID NO: 257 - protein, 8 aa, Streptococcus pyogenes
LLNDPNGF

SEQ ID NO: 258 - protein, 8 aa, Lactobacillus lactis
LLNDPNGF

SEQ ID NO: 259 - protein, 8 aa, Lactobacillus plantarum
LLNDPNGF

SEQ ID NO: 260 - protein, 8 aa, Pediococcus pentosaceus
LLNDPNGF

SEQ ID NO: 261 - protein, 8 aa, Enterococcus faecalis
LLNDPNGF

SEQ ID NO: 262 - protein, 8 aa, Staphylococcus aureus
LLNDPNGL

SEQ ID NO: 263 - protein, 8 aa, Staphylococcus xylosus
LLNDPNGL

SEQ ID NO: 264 - protein, 8 aa, Lactobacillus gasseri
MLGDPNGF

SEQ ID NO: 265 - protein, 8 aa, Clostridium beijerinckii
LINDPNGL

SEQ ID NO: 266 - protein, 8 aa, Clostridium perfringens
LINDPNGL

SEQ ID NO: 267 - protein, 8 aa, Bacillus subtilis
LLNDPNGV

SEQ ID NO: 268 - protein, 8 aa, Geobacillus stearothermophilus
LMNDPNGL

SEQ ID NO: 269 - protein, 8 aa, Bacillus halodurans
LLNDPNGF

SEQ ID NO: 270 - protein, 8 aa, Clostridium acetobutylicum
FMNDPNGL

SEQ ID NO: 271 - protein, 8 aa, Klebsiella pneumoniae
LLNDPNGF

SEQ ID NO: 272 - protein, 8 aa, Salmonella typhimurium
LMNDPNGF

SEQ ID NO: 273 - protein, 8 aa, Vibrio cholerae
LLNDPNGF

SEQ ID NO: 274 - protein, 8 aa, Ralstonia solanacearum
LLNDPNGL

SEQ ID NO: 275 - protein, 8 aa, Thermotoga maritima
WMNDPNGL

SEQ ID NO: 276 - protein, 8 aa, Bacillus subtilis
WMNDPNGM

SEQ ID NO: 277 - protein, 8 aa, Streptococcus mutans
WANDPNGL

SEQ ID NO: 278 - protein, 8 aa, Microbacterium laevaniformans
WMNDPQRP

SEQ ID NO: 279 - protein, 8 aa, Streptococcus mutans
FMNDIQTI

SEQ ID NO: 280 - protein, 4 aa, Artificial
  Consensus sequence
FRDP

SEQ ID NO: 281 - protein, 8 aa, Lactobacillus acidophilus
SNFRDPKV

SEQ ID NO: 282 - protein, 8 aa, Streptococcus pneumoniae
ADFRDPKL

SEQ ID NO: 283 - protein, 8 aa, Escherichia coli
MHFRDPKV

SEQ ID NO: 284 - protein, 8 aa, Bifidobacterium longum
HHYRDPKV

SEQ ID NO: 285 - protein, 8 aa, Pasteurella multocida
EHVRDPKP

SEQ ID NO: 286 - protein, 8 aa, Vibrio alginolyticus
EHFRDPKV

SEQ ID NO: 287 - protein, 8 aa, Lactobacillus acidophilus
EHFRDPQI

SEQ ID NO: 288 - protein, 8 aa, Lactobacillus gasseri
EHFRDPQL

SEQ ID NO: 289 - protein, 8 aa, Streptococcus mutans
EHFRDPQI

SEQ ID NO: 290 - protein, 8 aa, Streptococcus sobrinus
EHFRDPQI

SEQ ID NO: 291 - protein, 8 aa, Enterococcus faecalis
DHFRDPQI

SEQ ID NO: 292 - protein, 8 aa, Streptococcus pneumoniae
DHFRDPQI

SEQ ID NO: 293 - protein, 8 aa, Streptococcus agalactiae
EHFRDPQI

SEQ ID NO: 294 - protein, 8 aa, Streptococcus pyogenes
EHFRDPQL

SEQ ID NO: 295 - protein, 8 aa, Lactobacillus lactis
DHFRDPQI

SEQ ID NO: 296 - protein, 8 aa, Lactobacillus plantarum
SSFRDPDL

SEQ ID NO: 297 - protein, 8 aa, Pediococcus pentosaceus
SSFRDPDL

SEQ ID NO: 298 - protein, 8 aa, Enterococcus faecalis
SHFRDPMV

SEQ ID NO: 299 - protein, 8 aa, Staphylococcus aureus
SHFRDPKV

SEQ ID NO: 300 - protein, 8 aa, Staphylococcus xylosus
QHFRDPKV

SEQ ID NO: 301 - protein, 8 aa, Lactobacillus gasseri
GHFRDPKI

SEQ ID NO: 302 - protein, 8 aa, Clostridium beijerinckii
AHFRDPYV

SEQ ID NO: 303 - protein, 8 aa, Clostridium perfringens
AHFRDPYI

SEQ ID NO: 304 - protein, 8 aa, Bacillus subtilis
AHFSRSEV

SEQ ID NO: 305 - protein, 7 aa, Geobacillus stearothermophilus
AHFRDPK

SEQ ID NO: 306 - protein, 8 aa, Bacillus halodurans
AHFRDPKV

SEQ ID NO: 307 - protein, 8 aa, Clostridium acetobutylicum
RHFRDPKV

SEQ ID NO: 308 - protein, 8 aa, Klebsiella pneumoniae
GHVRDPKV

SEQ ID NO: 309 - protein, 8 aa, Salmonella typhimurium
GHVRDPKV

SEQ ID NO: 310 - protein, 8 aa, Vibrio cholerae
EHIRDPKV

SEQ ID NO: 311 - protein, 8 aa, Ralstonia solanacearum
GHFRDPKA

SEQ ID NO: 312 - protein, 8 aa, Thermotoga maritima
HAFRDPKV

SEQ ID NO: 313 - protein, 8 aa, Bacillus subtilis
KDFRDPKV

SEQ ID NO: 314 - protein, 8 aa, Streptococcus mutans
QDFRDPKV

SEQ ID NO: 315 - protein, 8 aa, Microbacterium laevaniformans
RDFRDPKV

SEQ ID NO: 316 - protein, 8 aa, Streptococcus mutans
QNARDPYI

SEQ ID NO: 317 - protein, 8 aa, Lactobacillus acidophilus
MTECPDYF

SEQ ID NO: 318 - protein, 8 aa, Streptococcus pneumoniae
MWECPDYF

SEQ ID NO: 319 - protein, 8 aa, Escherichia coli
MWECPDFF

SEQ ID NO: 320 - protein, 8 aa, Bifidobacterium longum
MLECPDFF

SEQ ID NO: 321 - protein, 8 aa, Pasteurella multocida
MWECPDLL

SEQ ID NO: 322 - protein, 8 aa, Vibrio alginolyticus
MWECPDFF

SEQ ID NO: 323 - protein, 8 aa, Lactobacillus acidophilus
MIECPNLV

SEQ ID NO: 324 - protein, 8 aa, Lactobacillus gasseri
MIECPNLV

SEQ ID NO: 325 - protein, 8 aa, Streptococcus mutans
MIECPNLV

SEQ ID NO: 326 - protein, 8 aa, Streptococcus sobrinus
MIECPNLV

SEQ ID NO: 327 - protein, 8 aa, Enterococcus faecalis
MIECPNLL

SEQ ID NO: 328 - protein, 8 aa, Streptococcus pneumoniae
MMECPNLV

SEQ ID NO: 329 - protein, 8 aa, Streptococcus agalactiae
MIECPNII

SEQ ID NO: 330 - protein, 8 aa, Streptococcus pyogenes
MIECPNLV

SEQ ID NO: 331 - protein, 8 aa, Lactobacillus lactis
MIECPNLI

SEQ ID NO: 332 - protein, 8 aa, Lactobacillus plantarum
MIECPNLV

SEQ ID NO: 333 - protein, 8 aa, Pediococcus pentosaceus
MIECPKSG

SEQ ID NO: 334 - protein, 8 aa, Enterococcus faecalis
MVECPNLV

SEQ ID NO: 335 - protein, 8 aa, Staphylococcus aureus
MWECPDYF

SEQ ID NO: 336 - protein, 8 aa, Staphylococcus xylosus
MWECPDYF

SEQ ID NO: 337 - protein, 8 aa, Lactobacillus gasseri
MWECSDYF

SEQ ID NO: 338 - protein, 8 aa, Clostridium beijerinckii
MWECPNII

SEQ ID NO: 339 - protein, 8 aa, Clostridium perfringens
MWECPSFF

SEQ ID NO: 340 - protein, 8 aa, Bacillus subtilis
MWECPDLF

SEQ ID NO: 341 - protein, 8 aa, Geobacillus stearothermophilus
MWECPDLF

SEQ ID NO: 342 - protein, 8 aa, Bacillus halodurans
MWECPDLF

SEQ ID NO: 343 - protein, 8 aa, Clostridium acetobutylicum
MWECPNLF

SEQ ID NO: 344 - protein, 8 aa, Klebsiella pneumoniae
MWECPDLF

SEQ ID NO: 345 - protein, 8 aa, Salmonella typhimurium
MWECPDLF

SEQ ID NO: 346 - protein, 8 aa, Vibrio cholerae
MWECPDWF

SEQ ID NO: 347 - protein, 8 aa, Ralstonia solanacearum
MYECPDLF

SEQ ID NO: 348 - protein, 8 aa, Thermotoga maritima
EIECPDLV

SEQ ID NO: 349 - protein, 8 aa, Bacillus subtilis
VWECPDLF

SEQ ID NO: 350 - protein, 8 aa, Streptococcus mutans
HTECPDMY

SEQ ID NO: 351 - protein, 8 aa, Microbacterium laevaniforman
TIECPDLF

SEQ ID NO: 352 - protein, 8 aa, Streptococcus mutans
LVECPNLK

SEQ ID NO: 353 - DNA, 204 bp, Lactobacillus acidophilus
taactgttgacaagttgtgaaagcgatattatcatttaattgtaaattgaaaacgtttccaaagtgttcaaatagttttttgctaaataattatttttttgtagcgaaatagaaacgtttcaattaatttaaaacaattagatcttagtaggaaaccttttaatttttgtgcaaaattgaaacgtttcaaaaggaggaaaaatg

SEQ ID NO: 354 - DNA, 198 bp, Lactobacillus acidophilus
ctgttgacaagttgtgaaagcgatattatcatttaattgtaaattgaaaacgtttccaaagtgttcaaatagttttttgctaaataattatttttttgtagcgaaatagaaacgtttcaattaatttaaaacaattagatcttagtaggaaaccttttaatttttgtgcaaaattgaaacgtttcaaaaggaggaaaa

SEQ ID NO: 355 - DNA, 240 bp, Lactobacillus acidophilus
  misc_feature (129)..(142): cre2 sequence
  misc_feature (196)..(209): cre1 sequence
aaatggcaataccacaaaataactgttgacaagttgtgaaagcgatattatcatttaattgtaaattgaaaacgtttccaaagtgttcaaatagttttttgctaaataattatttttttgtagcgaaatagaaacgtttcaattaatttaaaacaattagatcttagtaggaaaccttttaatttttgtgcaaaattgaaacgtttcaaaaggaggaaaaatgaaaaaatggaaattagg

That which is claimed is:

1. An isolated nucleic acid molecule comprising a nucleotide sequence that encodes a polypeptide comprising an amino acid sequence having at least 95% sequence identity to the amino acid sequence of SEQ ID NO: 12, wherein said polypeptide has sucrose phosphorylase activity or a full length complement thereof.

2. A plasmid comprising the nucleic acid molecule of claim 1.

3. The plasmid of claim 2, further comprising a nucleic acid molecule encoding a heterologous polypeptide.

4. A microbial host cell comprising the heterologous plasmid of claim 2.

5. The microbial host cell of claim 4 wherein said microbial cell is a bacterial host cell.

6. A method for producing a polypeptide having sucrose phosphorylase activity comprising culturing a microbial host cell comprising the heterologous nucleic acid molecule that encodes a polypeptide comprising an amino acid sequence having at least 95% sequence identity to the amino acid sequence of SEQ ID NO: 12, wherein said microbial host cell is cultured under conditions in which the nucleic acid molecule is expressed.

7. A microbial host cell comprising a heterologous nucleic acid molecule that encodes a polypeptide comprising an amino acid sequence having at least 95% sequence identity to the amino acid sequence of SEQ ID NO: 12, wherein said polypeptide has sucrose phosphorylase activity.

8. The microbial host cell of claim 7, wherein said microbial host cell is a bacterial host cell.

9. The microbial host cell of claim 8, wherein said bacterial host cell is a lactic acid bacterium.

10. The microbial host cell of claim 9, wherein said lactic acid bacterium has an enhanced ability to colonize the gastrointestinal tract of a host compared to the corresponding wild-type lactic acid bacterium lacking said nucleic acid molecule.

11. The microbial host cell of 9 wherein said lactic acid bacterium does not utilize fructo-oligosaccharide (FOS) in the absence of said nucleic acid molecule.

12. The microbial host cell of claim 9, wherein said lactic acid bacterium has an enhanced ability to metabolize FOS or other complex carbohydrates compared to the corresponding wild-type lactic acid bacterium lacking said nucleic acid molecule.

13. The microbial host cell of claim 9, wherein said lactic acid bacterium comprises *Lactobacillus acidophilus*.

14. The microbial host cell of claim 7, wherein said nucleic acid molecule comprises the nucleotide sequence of SEQ ID NO: 11.

15. The microbial host cell of claim 7, wherein said nucleic acid molecule comprises a nucleotide sequence having at least 95% sequence identity to the nucleotide sequence of SEQ ID NO: 11.

16. The microbial host cell of claim 7, wherein said nucleic acid molecule comprises a nucleotide sequence that encodes a polypeptide comprising the amino acid sequence of SEQ ID NO: 12.

17. The isolated nucleic acid molecule of claim 1, wherein said nucleic acid molecule comprises the nucleotide sequence of SEQ ID NO: 11.

18. The isolated nucleic acid molecule of claim 1, wherein said nucleic acid molecule comprises a nucleotide sequence having at least 95% sequence identity to the nucleotide sequence of SEQ ID NO: 11.

19. The isolated nucleic acid molecule of claim 1, wherein said nucleic acid molecule comprises a nucleotide sequence that encodes a polypeptide comprising the amino acid sequence of SEQ ID NO: 12.

20. The plasmid of claim 2, wherein said nucleic acid molecule comprises the nucleotide sequence of SEQ ID NO: 11.

21. The plasmid of claim 2, wherein said nucleic acid molecule comprises a nucleotide sequence having at least 95% sequence identity to the nucleotide sequence of SEQ ID NO: 11.

22. The plasmid of claim 2, wherein said nucleic acid molecule comprises a nucleotide sequence that encodes a polypeptide comprising the amino acid sequence of SEQ ID NO: 12.

23. A culture comprising the microbial host cell of claim 7.

24. A culture comprising the microbial host cell of claim 9.

25. The method of claim 6, wherein said nucleic acid molecule comprises the nucleotide sequence of SEQ ID NO: 11.

26. The method of claim 6, wherein said nucleic acid molecule comprises a nucleotide sequence having at least 95% sequence identity to the nucleotide sequence of SEQ ID NO: 11.

27. The method of claim 6, wherein said nucleic acid molecule comprises a nucleotide sequence that encodes a polypeptide comprising the amino acid sequence of SEQ ID NO: 12.

28. The method of claim 6, wherein said microbial host cell is a bacterial host cell.

29. The method of claim 28, wherein said bacterial host cell is a lactic acid bacterium.

30. The method of claim 29, wherein said lactic acid bacterium is *Lactobacillus acidophilus*.

\* \* \* \* \*